United States Patent 12,508,308 (INFLUENZA mRNA VACCINES) - sequence listing, part 3

SEQ ID NO: 7937 - protein, 566 aa, Artificial Sequence
  hemagglutinin__InfluenzaA__AEX09175
MKAILVVLLYTFATANADTLCIGYHANNSTDTVDTVLEKNVAVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7938 - protein, 566 aa, Artificial Sequence; identical to SEQ ID NO: 2669
  hemagglutinin__InfluenzaA__AEX25795

SEQ ID NO: 7939 - protein, 566 aa, Artificial Sequence
  hemagglutinin__InfluenzaA__AEX25797
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7940 - protein, 566 aa, Artificial Sequence
  hemagglutinin__InfluenzaA__AEX25798
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7941 - protein, 566 aa, Artificial Sequence; identical to SEQ ID NO: 2669
  hemagglutinin__InfluenzaA__AEX25800

SEQ ID NO: 7942 - protein, 566 aa, Artificial Sequence; identical to SEQ ID NO: 2669
  hemagglutinin__InfluenzaA__AEX25803

SEQ ID NO: 7943 - protein, 566 aa, Artificial Sequence; identical to SEQ ID NO: 2911
  hemagglutinin__InfluenzaA__AEX25808

SEQ ID NO: 7944 - protein, 566 aa, Artificial Sequence; identical to SEQ ID NO: 5639
  hemagglutinin__InfluenzaA__AEX25810

SEQ ID NO: 7945 - protein, 566 aa, Artificial Sequence
  hemagglutinin__InfluenzaA__AEX25811
MEAILVVLLYTFATANADTLCIGYHANNSTDTVDTVLEKNVTVTHSVNLLEDKHNGKLCKLRGVAPLHLGKCNIAGWILGNPECESLFTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERKAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7946 - protein, 566 aa, Artificial Sequence; identical to SEQ ID NO: 5639
  hemagglutinin__InfluenzaA__AEX25814

SEQ ID NO: 7947 - protein, 566 aa, Artificial Sequence
  hemagglutinin__InfluenzaA__AEX25816
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7948 - protein, 566 aa, Artificial Sequence
  hemagglutinin__InfluenzaA__AEX25818
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHQSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7949 - protein, 566 aa, Artificial Sequence
  hemagglutinin__InfluenzaA__AEX25824
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVESTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7950 - protein, 565 aa, Artificial Sequence
  hemagglutinin__InfluenzaA__AEX33420
MKVKLLVLLCIFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKSGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVKSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7951 - protein, 566 aa, Artificial Sequence
  hemagglutinin__InfluenzaA__AEX33453
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7952 - protein, 566 aa, Artificial Sequence; identical to SEQ ID NO: 1795
  hemagglutinin__InfluenzaA__AEX33464

SEQ ID NO: 7953 - protein, 566 aa, Artificial Sequence; identical to SEQ ID NO: 1795
  hemagglutinin__InfluenzaA__AEX33475

SEQ ID NO: 7954 - protein, 566 aa, Artificial Sequence; identical to SEQ ID NO: 1795
  hemagglutinin__InfluenzaA__AEX33486

SEQ ID NO: 7955 - protein, 566 aa, Artificial Sequence; identical to SEQ ID NO: 1795
  hemagglutinin__InfluenzaA__AEX33497

SEQ ID NO: 7956 - protein, 566 aa, Artificial Sequence; identical to SEQ ID NO: 1795
  hemagglutinin__InfluenzaA__AEX33508

SEQ ID NO: 7957 - protein, 566 aa, Artificial Sequence; identical to SEQ ID NO: 1795
  hemagglutinin__InfluenzaA__AEX33519

SEQ ID NO: 7958 - protein, 566 aa, Artificial Sequence
  hemagglutinin__InfluenzaA__AEX33541
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSSCKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7959 - protein, 566 aa, Artificial Sequence
  hemagglutinin__InfluenzaA__AEX33574
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNDCIGSIRNGTYDHDVYRDEALNNRFQIKGVELKSGYKDWILWISFAISCFLLCVALLGFIMWACQKGNIRCNICI

SEQ ID NO: 7960 - protein, 566 aa, Artificial Sequence; identical to SEQ ID NO: 1795
  hemagglutinin__InfluenzaA__AEX33585

SEQ ID NO: 7961 - protein, 566 aa, Artificial Sequence
  hemagglutinin__InfluenzaA__AEX33596
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7962 - protein, 566 aa, Artificial Sequence; identical to SEQ ID NO: 1795
  hemagglutinin__InfluenzaA__AEX33618

SEQ ID NO: 7963 - protein, 566 aa, Artificial Sequence; identical to SEQ ID NO: 1795
  hemagglutinin__InfluenzaA__AEX33629

SEQ ID NO: 7964 - protein, 566 aa, Artificial Sequence; identical to SEQ ID NO: 7961
  hemagglutinin__InfluenzaA__AEX33640

SEQ ID NO: 7965 - protein, 566 aa, Artificial Sequence
  hemagglutinin__InfluenzaA__AEX33836
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDIFLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7966 - protein, 566 aa, Artificial Sequence; identical to SEQ ID NO: 630
  hemagglutinin__InfluenzaA__AEX33880

SEQ ID NO: 7967 - protein, 565 aa, Artificial Sequence
  hemagglutinin__InfluenzaA__AEX33913
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKENSWPNHTTTGVSASCSHNGESSFYKNLLWLTGKNGLYPNLSKSYANNKKKEVLVLWGVHHPPNIGNQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKFESMGVYQILAIYSTVASSLVLLVSLGAISFWMCSNGSLQCRICI

SEQ ID NO: 7968 - protein, 565 aa, Artificial Sequence
  hemagglutinin__InfluenzaA__AEX33924
MKVKLLVLLCTFTATYADTICIGYHANNSTDTVDTVLEKNVTVTHSVNLLEDSHNGKLCLLKGIAPLQLGNCSVAGWILGNPECESLISRESWSYIVEKPSPENGTCYPGHFADYEELREQLSSVSSFERFEIFPKESSWPNHTATGVSASCSHNGKSSFYKNLLWLTGKNGLYPNLSKSYANNKEKEVLVLWGVHHPPNIGDQRALYHTENAYVSVVSSHYSRKFTPEIAKRPKVRDQKGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7969 - protein, 566 aa, Artificial Sequence
  hemagglutinin__InfluenzaA__AEX33957
MKTIIALSYILCLVFAQKLPGIDNSTATLCLGHHAVPNGTIVKTITNDQVEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7970 - protein, 566 aa, Artificial Sequence
  hemagglutinin__InfluenzaA__AEX33968
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLHAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7971 - protein, 566 aa, Artificial Sequence
  hemagglutinin__InfluenzaA__AEX33979
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQINGVELKSGYKDWILWISFAISCFLLCVALLGFIMWACQKGNIRCNICI

SEQ ID NO: 7972 - protein, 566 aa, Artificial Sequence
  hemagglutinin__InfluenzaA__AEX33990
MKTIIALSYILYLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQDTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKSVELKSGYKDWILWISFAISCFLLCVALLGFIMWACQKGNIRCNICI

SEQ ID NO: 7973 - protein, 566 aa, Artificial Sequence
  hemagglutinin__InfluenzaA__AEX34001
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNSESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNAEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7974 - protein, 566 aa, Artificial Sequence
  hemagglutinin__InfluenzaA__AEX34012
MKTIIALSYILYLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7975 - protein, 566 aa, Artificial Sequence; identical to SEQ ID NO: 2434
  hemagglutinin__InfluenzaA__AEX34023

SEQ ID NO: 7976 - protein, 566 aa, Artificial Sequence
  hemagglutinin__InfluenzaA__AEX34044
MKTIIAFSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7977 - protein, 566 aa, Artificial Sequence
  hemagglutinin__InfluenzaA__AEX34089
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSSNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7978 - protein, 566 aa, Artificial Sequence
  hemagglutinin__InfluenzaA__AEX34123
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7979 - protein, 566 aa, Artificial Sequence
  hemagglutinin__InfluenzaA__AEX34134
MKTIIALSYILCLVFAQKLPGNDNSMATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7980 - protein, 566 aa, Artificial Sequence; identical to SEQ ID NO: 7978
  hemagglutinin__InfluenzaA__AEX34145

SEQ ID NO: 7981 - protein, 566 aa, Artificial Sequence
  hemagglutinin__InfluenzaA__AEX34156
MKTIIALSYILCLVFAQKLPGNDNSTATLCLGHHAVPNGTIVKTITNDQIEVTNATELVQSSSTGEICGSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 7982 - protein, 566 aa, Artificial Sequence; identical to SEQ ID NO: 1928
  hemagglutinin__InfluenzaA__AEX34178

SEQ ID NO: 7983 - protein, 566 aa, Artificial Sequence
  hemagglutinin__InfluenzaA__AEX34188
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHLKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 7984 - protein, 566 aa, Artificial Sequence; identical to SEQ ID NO: 2434
  hemagglutinin__InfluenzaA__AEX34199

SEQ ID NO: 7985 - protein, 566 aa, Artificial Sequence
  hemagglutinin__InfluenzaA__AEX34221
MKTIIALSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCDSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7986 - protein, 566 aa, Artificial Sequence; identical to SEQ ID NO: 1928
  hemagglutinin__InfluenzaA__AEX34243

SEQ ID NO: 7987 - protein, 566 aa, Artificial Sequence; identical to SEQ ID NO: 7983
  hemagglutinin__InfluenzaA__AEX34254

SEQ ID NO: 7988 - protein, 566 aa, Artificial Sequence; identical to SEQ ID NO: 1928
  hemagglutinin__InfluenzaA__AEX34265

SEQ ID NO: 7989 - protein, 566 aa, Artificial Sequence
  hemagglutinin__InfluenzaA__AEX34275
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVLHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHYVYRDEALNNRFQIKGVELKSGYKDWILWISFAISCFLLCVALLGFIMWACQKGNIRCNICI

SEQ ID NO: 7990 - protein, 565 aa, Artificial Sequence; identical to SEQ ID NO: 2488
  hemagglutinin__InfluenzaA__AEX34318

SEQ ID NO: 7991 - protein, 565 aa, Artificial Sequence
  hemagglutinin__InfluenzaA__AEX34329
MKVKLLVLLCTFTATYADTICIGYHANNSTDTVDTVLEKNVTVTHSVNLLENSHNGKLCLLKGIAPLQLGNCSVAGWILGNPECELLVSKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIEGVKLESMGVYQILAIYSTVASSLVLLVSLGAISFWMCSNGSLQCRICI

SEQ ID NO: 7992 - protein, 566 aa, Artificial Sequence
  hemagglutinin__InfluenzaA__AEX34352
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSILNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7993 - protein, 566 aa, Artificial Sequence; identical to SEQ ID NO: 2434
  hemagglutinin__InfluenzaA__AEX34364

SEQ ID NO: 7994 - protein, 566 aa, Artificial Sequence; identical to SEQ ID NO: 2434
  hemagglutinin__InfluenzaA__AEX34375

SEQ ID NO: 7995 - protein, 566 aa, Artificial Sequence
  hemagglutinin__InfluenzaA__AEX34386
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFIERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7996 - protein, 566 aa, Artificial Sequence
  hemagglutinin__InfluenzaA__AEX34407
MKTIIALSYILCLVFAQKLPGNDNSMATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKILSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKVDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7997 - protein, 565 aa, Artificial Sequence
  hemagglutinin__InfluenzaA__AEX34440
MKVKLLVLLCTFTATYADTICIGYHANNSTDTVDTVLEKNVTVTHSVNLLEDSHNGKLCLLKGIAPLQLGNCSVAGWILGNPECELLTSRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGNQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7998 - protein, 565 aa, Artificial Sequence; identical to SEQ ID NO: 299
  hemagglutinin__InfluenzaA__AEX34462

SEQ ID NO: 7999 - protein, 565 aa, Artificial Sequence
  hemagglutinin__InfluenzaA__AEX34473
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKSGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVKSAKLRMVTGLRNIPSIQSRGLFGAIAGFIEGGWTGMVDGWYGYHHQNEQGSGYAADQKSTQSAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8000 - protein, 565 aa, Artificial Sequence
  hemagglutinin__InfluenzaA__AEX34495
MKVKLLVLLCIFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKSGLYPNLSKSYANNKEKEVLVLWGVHHPPNIGVQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVKSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8001 - protein, 565 aa, Artificial Sequence; identical to SEQ ID NO: 8000
  hemagglutinin__InfluenzaA__AEX34506

SEQ ID NO: 8002 - protein, 565 aa, Artificial Sequence; identical to SEQ ID NO: 8000
  hemagglutinin__InfluenzaA__AEX34517

SEQ ID NO: 8003 - protein, 565 aa, Artificial Sequence; identical to SEQ ID NO: 8000
  hemagglutinin__InfluenzaA__AEX34528

SEQ ID NO: 8004 - protein, 565 aa, Artificial Sequence; identical to SEQ ID NO: 8000
  hemagglutinin__InfluenzaA__AEX34539

SEQ ID NO: 8005 - protein, 565 aa, Artificial Sequence; identical to SEQ ID NO: 8000
  hemagglutinin__InfluenzaA__AEX34550

SEQ ID NO: 8006 - protein, 565 aa, Artificial Sequence; identical to SEQ ID NO: 8000
  hemagglutinin__InfluenzaA__AEX34561

SEQ ID NO: 8007 - protein, 565 aa, Artificial Sequence; identical to SEQ ID NO: 8000
  hemagglutinin__InfluenzaA__AEX34572

SEQ ID NO: 8008 - protein, 565 aa, Artificial Sequence; identical to SEQ ID NO: 8000
  hemagglutinin__InfluenzaA__AEX34583

SEQ ID NO: 8009 - protein, 565 aa, Artificial Sequence; identical to SEQ ID NO: 8000
  hemagglutinin__InfluenzaA__AEX34594

SEQ ID NO: 8010 - protein, 565 aa, Artificial Sequence; identical to SEQ ID NO: 8000
  hemagglutinin__InfluenzaA__AEX34605

SEQ ID NO: 8011 - protein, 565 aa, Artificial Sequence; identical to SEQ ID NO: 8000
  hemagglutinin__InfluenzaA__AEX34616

SEQ ID NO: 8012 - protein, 565 aa, Artificial Sequence; identical to SEQ ID NO: 8000
  hemagglutinin__InfluenzaA__AEX34627

SEQ ID NO: 8013 - protein, 565 aa, Artificial Sequence; identical to SEQ ID NO: 8000
  hemagglutinin__InfluenzaA__AEX34638

SEQ ID NO: 8014 - protein, 565 aa, Artificial Sequence
  hemagglutinin__InfluenzaA__AEX34650
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGNQRSLYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8015 - protein, 565 aa, Artificial Sequence
  hemagglutinin__InfluenzaA__AEX34661
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKKGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITKKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8016 - protein, 565 aa, Artificial Sequence
  hemagglutinin__InfluenzaA__AEX34672
MKVKLLVLLCTFTATYADTICIGYHANNSTDTVDTVLDKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHDGESSFYKNLLWLTGKNGLYPNLSKSYANNKEKEVLVLWGVHHPPNIGVQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8017 - protein, 565 aa, Artificial Sequence
  hemagglutinin__InfluenzaA__AEX34683
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPYHTTTGVSASCSHNGESSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGFGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8018 - protein, 565 aa, Artificial Sequence
  hemagglutinin__InfluenzaA__AEX34757
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGGSSFYKNLLWLTRKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8019 - protein, 565 aa, Artificial Sequence
  hemagglutinin__InfluenzaA__AEX34768
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKDSSWPNHTTTGVSASCSHNGESSFYKNLLWLTGKNGLYPNLSKSYANNKEKEVLVLWGVHHPPNIGDQRALYHTENAYVSVVSSHYSRKFTPEIAKRPKVRDQGGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8020 - protein, 565 aa, Artificial Sequence
  hemagglutinin__InfluenzaA__AEX34779
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGERSFYRNLLWLTGKNGLYPNLSKSYANNKEKEVLVLWGVHHPPNIGNQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8021 - protein, 565 aa, Artificial Sequence; identical to SEQ ID NO: 4097
  hemagglutinin__InfluenzaA__AEX34790

SEQ ID NO: 8022 - protein, 565 aa, Artificial Sequence
  hemagglutinin__InfluenzaA__AEX34801
MKVKLLVLLCTFTATYADTICIGYHANNSTDTVDTVLEKNVTVTHSVNLLEDNHNGKLCLLKGIAPLQLGNCSVAGWILGNPECELLISKESWSYIVEKPNPENGACYPGHFADYEELREQLSSVSSFKRFEIFPKESSWPNHTVTGVSASCSHNGESSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEASGNLIAPRYAFALSRGFGSGIINSDAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 8023 - protein, 565 aa, Artificial Sequence
  hemagglutinin__InfluenzaA__AEX34812
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAIDGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8024 - protein, 565 aa, Artificial Sequence
  hemagglutinin__InfluenzaA__AEX34834
MKVKLLVLLCTFTATYADTICIGYHANNSTDTVDTVLEKNVTVTHSVNLLEDNHNGKLCLLKGIAPLQLGNCSVAGWILGNPECELLNSKESWSYIVEKPNPENGTCYPGHFADYEELREQLSSVSSFKRFEIFPKESSWPNHTVTGVSASCSHNGESSFYKNLLWLTGKNGLYPNLSKSYANNKEKEVLVLWGVHHPPNIGDQMTLYHKENAYVSVVSSHYSRKFTPEITKRPKVRDQEGRINYYWTLLEPGDTIIFEASGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 8025 - protein, 565 aa, Artificial Sequence
  hemagglutinin__InfluenzaA__AEX34845
MKVKLLVLLCTFTATYADTICIGYHANNSTDTVDTVLEKNVTVTHSVNLLENSHNGKLCLLKGIAPLQLGNCSVAGWILGNPECELLVPKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIEGVKLESMGVYQILAIYSTVASSLVLLVSLGAISFWMCSNGSLQCRICI

SEQ ID NO: 8026 - protein, 565 aa, Artificial Sequence; identical to SEQ ID NO: 4097
  hemagglutinin__InfluenzaA__AEX34856

SEQ ID NO: 8027 - protein, 565 aa, Artificial Sequence
  hemagglutinin__InfluenzaA__AEX34867
MKVKLLVLLCTFTATYADTICIGYHANNSTDTVDTVLEKNVTVTHSVNLLENSHNGKLCLLKGIAPLQLGNCSVAGWILGNPECELLVSKESWSYIVEKPNPENGTCYPGHFADYEELREQLISVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIEGVKLESMGVYQILAIYSTVASSLVLLVSLGAISFWMCSNGSLQCRICI

SEQ ID NO: 8028 - protein, 565 aa, Artificial Sequence; identical to SEQ ID NO: 4097
  hemagglutinin__InfluenzaA__AEX34878

SEQ ID NO: 8029 - protein, 565 aa, Artificial Sequence
  hemagglutinin__InfluenzaA__AEX34889
MKVNLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8030 - protein, 565 aa, Artificial Sequence
  hemagglutinin__InfluenzaA__AEX34900
MKVKLLVLLCTFTATYADTICIGYHANNSTDTVDTVLEKNVTVTHSVNLLEDNHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEASGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGVTNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVELESMGVYQILAIYSTVASSLVLLVSLGAISFWMCSNGSLQCRICI

SEQ ID NO: 8031 - protein, 565 aa, Artificial Sequence
  hemagglutinin__InfluenzaA__AEX34911
MKVKLLVLLCTFTATYADTICIGYHANNSTDTVDTVLEKNVTVTHSVNLLENSHNGKLCLLKGIAPLQLGNCSVAGWILGNPECELLISQESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLGSMGVYQILAIYSTVASSLVLLVSLGAISFWMCSNGSLQCRICI

SEQ ID NO: 8032 - protein, 565 aa, Artificial Sequence
  hemagglutinin__InfluenzaA__AEX34922
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRRFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLDKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8033 - protein, 565 aa, Artificial Sequence; identical to SEQ ID NO: 2488
  hemagglutinin__InfluenzaA__AEX34933

SEQ ID NO: 8034 - protein, 565 aa, Artificial Sequence; identical to SEQ ID NO: 2488
  hemagglutinin__InfluenzaA__AEX34944

SEQ ID NO: 8035 - protein, 565 aa, Artificial Sequence
  hemagglutinin__InfluenzaA__AEX34955
MKAKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8036 - protein, 565 aa, Artificial Sequence
  hemagglutinin__InfluenzaA__AEX34966
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIMFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8037 - protein, 565 aa, Artificial Sequence; identical to SEQ ID NO: 8036
  hemagglutinin__InfluenzaA__AEX34977

SEQ ID NO: 8038 - protein, 565 aa, Artificial Sequence; identical to SEQ ID NO: 8036
  hemagglutinin__InfluenzaA__AEX34988

SEQ ID NO: 8039 - protein, 565 aa, Artificial Sequence; identical to SEQ ID NO: 4097
  hemagglutinin__InfluenzaA__AEX34999

SEQ ID NO: 8040 - protein, 565 aa, Artificial Sequence; identical to SEQ ID NO: 8036
  hemagglutinin__InfluenzaA__AEX35010

SEQ ID NO: 8041 - protein, 565 aa, Artificial Sequence; identical to SEQ ID NO: 8036
  hemagglutinin__InfluenzaA__AEX35032

SEQ ID NO: 8042 - protein, 565 aa, Artificial Sequence; identical to SEQ ID NO: 8036
  hemagglutinin__InfluenzaA__AEX35043

SEQ ID NO: 8043 - protein, 565 aa, Artificial Sequence
  hemagglutinin__InfluenzaA__AEX35054
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIMFEANGNLIAPRYAFALNRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8044 - protein, 565 aa, Artificial Sequence; identical to SEQ ID NO: 8036
  hemagglutinin__InfluenzaA__AEX35065

SEQ ID NO: 8045 - protein, 565 aa, Artificial Sequence; identical to SEQ ID NO: 2488
  hemagglutinin__InfluenzaA__AEX35076

SEQ ID NO: 8046 - protein, 565 aa, Artificial Sequence
  hemagglutinin__InfluenzaA__AEX35087
MKVKLLVLLCTFTATYADTICIGYHANNSTDTVDTVLEKNVTVTHSVNLLEDNHNGKLCLLKGIAPLQLGNCSVAGWILGNPECELLISKESWSYIVEKPNPENGTCYPGHFADYEELREQLSSVSSFKRFEIFPKESSWPNHTVTGVSASCSHNGESSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEASGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 8047 - protein, 565 aa, Artificial Sequence
  hemagglutinin__InfluenzaA__AEX35098
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVMSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8048 - protein, 565 aa, Artificial Sequence
  hemagglutinin__InfluenzaA__AEX35109
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHQPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8049 - protein, 565 aa, Artificial Sequence
  hemagglutinin__InfluenzaA__AEX35120
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDREGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8050 - protein, 565 aa, Artificial Sequence; identical to SEQ ID NO: 7793
  hemagglutinin__InfluenzaA__AEX35131

SEQ ID NO: 8051 - protein, 565 aa, Artificial Sequence; identical to SEQ ID NO: 7793
  hemagglutinin__InfluenzaA__AEX35142

SEQ ID NO: 8052 - protein, 565 aa, Artificial Sequence
  hemagglutinin__InfluenzaA__AEX35153
MKVKLLVLLCTFTATYADTICIGYHANNSTDTVDTVLEKNVTVTHSVNLLEDNHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGNQMTLYHKENAYVSVVSSHYSRKFTPEIAKRPKVRDQEGRINYYWTLLEPGDTIIFEASGNLIAPRYAFALSRGFGSGIINSNAPMDECDAKCQTPQGAINSNLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKSLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 8053 - protein, 565 aa, Artificial Sequence
  hemagglutinin__InfluenzaA__AEX35164
MKVKLLVLLCAFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGVQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8054 - protein, 565 aa, Artificial Sequence
  hemagglutinin__InfluenzaA__AEX35175
MKVKLLVLLCTFTATYADTICIGYHANNSTDTVDTVLEKNVTVTHSVDLLEDSHNGKLCLLKGIAPLQLGNCSVAGWILGNPECELLISKESWSYIVETPNPENGTCYPGYFADYEELREQLSSVSSFERFEIFPKESSWPNHTVTGVTASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALNRGFGSGIITSNAPMDGCDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8055 - protein, 565 aa, Artificial Sequence
  hemagglutinin__InfluenzaA__AEX35186
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGNQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8056 - protein, 565 aa, Artificial Sequence; identical to SEQ ID NO: 8055
  hemagglutinin__InfluenzaA__AEX35197

SEQ ID NO: 8057 - protein, 565 aa, Artificial Sequence; identical to SEQ ID NO: 2488
  hemagglutinin__InfluenzaA__AEX35208

SEQ ID NO: 8058 - protein, 566 aa, Artificial Sequence
  hemagglutinin__InfluenzaA__AEX35219
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAMSCFLLCVVLLGFIMWACQKGNIRCNICI

SEQ ID NO: 8059 - protein, 565 aa, Artificial Sequence; identical to SEQ ID NO: 8000
  hemagglutinin__InfluenzaA__AEX35230

SEQ ID NO: 8060 - protein, 566 aa, Artificial Sequence; identical to SEQ ID NO: 1897
  hemagglutinin__InfluenzaA__AEX35241

SEQ ID NO: 8061 - protein, 565 aa, Artificial Sequence; identical to SEQ ID NO: 8000
  hemagglutinin__InfluenzaA__AEX35263

SEQ ID NO: 8062 - protein, 565 aa, Artificial Sequence; identical to SEQ ID NO: 8000
  hemagglutinin__InfluenzaA__AEX35274

SEQ ID NO: 8063 - protein, 566 aa, Artificial Sequence; identical to SEQ ID NO: 1795
  hemagglutinin__InfluenzaA__AEX35285

SEQ ID NO: 8064 - protein, 566 aa, Artificial Sequence; identical to SEQ ID NO: 7961
  hemagglutinin__InfluenzaA__AEX35296

SEQ ID NO: 8065 - protein, 566 aa, Artificial Sequence
  hemagglutinin__InfluenzaA__AEX35307
MKTIIALSYILCLVFAQKIPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8066 - protein, 566 aa, Artificial Sequence; identical to SEQ ID NO: 7961
  hemagglutinin__InfluenzaA__AEX35318

SEQ ID NO: 8067 - protein, 566 aa, Artificial Sequence
  hemagglutinin__InfluenzaA__AEX35329
MKTIIALSYFLCLVFAQKLPGNDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8068 - protein, 566 aa, Artificial Sequence
  hemagglutinin__InfluenzaA__AEX35340
MKTIIALSYILCLVFAQKLPGNDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8069 - protein, 566 aa, Artificial Sequence; identical to SEQ ID NO: 7961
  hemagglutinin__InfluenzaA__AEX35351

SEQ ID NO: 8070 - protein, 566 aa, Artificial Sequence; identical to SEQ ID NO: 7961
  hemagglutinin__InfluenzaA__AEX35362

SEQ ID NO: 8071 - protein, 566 aa, Artificial Sequence; identical to SEQ ID NO: 1795
  hemagglutinin__InfluenzaA__AEX35373

SEQ ID NO: 8072 - protein, 566 aa, Artificial Sequence
  hemagglutinin__InfluenzaA__AEX35384
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALSVTMPNNEKFDKLYIWGVHHPGTDNDQISLYAQASGRITVSTKRSQQTVIPNIGSRTRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8073 - protein, 566 aa, Artificial Sequence
  hemagglutinin__InfluenzaA__AEX35395
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWNLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8074 - protein, 566 aa, Artificial Sequence; identical to SEQ ID NO: 1795
  hemagglutinin__InfluenzaA__AEX35406

SEQ ID NO: 8075 - protein, 566 aa, Artificial Sequence; identical to SEQ ID NO: 1795
  hemagglutinin__InfluenzaA__AEX35417

SEQ ID NO: 8076 - protein, 566 aa, Artificial Sequence
  hemagglutinin__InfluenzaA__AEX35428
MKTIIALSYILCLVFAQKLPGNDNSTATLCLGHHAVPNGTLVKTITNDQIEVTNATELVQSSSTGGICDSPHQILDGENCTLIDALLGDPHCDGFQNKKWDLFVERSKAYSNCYPYDVPDYASLRSLVASSGTLEFNNESFNWTGVAQNGTSSACKRRSDKSFFSRLNWLHQLKYKYPALNVTMPNNEKFDKLYIWGVHHPGTDSDQISLYAQASGRITVSTKRSQQTVIPNIGSRPRVRDVSSRISIYWTIVKPGDILFINSTGNLIAPRGYFKIRSGKSSIMRSDAPIDKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8077 - protein, 565 aa, Artificial Sequence
  hemagglutinin__InfluenzaA__AEX35439
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8078 - protein, 566 aa, Artificial Sequence
  hemagglutinin__InfluenzaA__AEX35450
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNENFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8079 - protein, 566 aa, Artificial Sequence; identical to SEQ ID NO: 630
  hemagglutinin__InfluenzaA__AEX35461

SEQ ID NO: 8080 - protein, 566 aa, Artificial Sequence
  hemagglutinin__InfluenzaA__AEX35472
MKTIIALSYILCLVFAQKLPGNDNSTATLCLGHHAVPNGTIVKTITNDQIEVTNATELVQSSSTGGICDSPHQILDGENCTLIDALLGDPQCDDFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8081 - protein, 566 aa, Artificial Sequence; identical to SEQ ID NO: 630
  hemagglutinin__InfluenzaA__AEX35483

SEQ ID NO: 8082 - protein, 566 aa, Artificial Sequence
  hemagglutinin__InfluenzaA__AEX35494
MKTIIALSYILCLVFAQKLPGNDNSTATLCLGHHAVPNGTIVKTITNDQIEVTNATELVQSSSTGGICDSPHQILDGENCTLIDALLGDPQCDGLQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8083 - protein, 566 aa, Artificial Sequence
  hemagglutinin__InfluenzaA__AEX35505
MKTIIALSYILCLVFAQKLPGNDNSTATLCLGHHAVPNGTIVKTITNDQIEVTNATELVQSSSTGGICDSPHQILDGENCTLIDALLGDPQCDDFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKILSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8084 - protein, 566 aa, Artificial Sequence
  hemagglutinin__InfluenzaA__AEX35516
MKTIIALSYILCLVFAQKLPGNDNSTATLCLGHHAVPNGTIVKTITNDQIEVTNATELVQSSSTGGICDSPHQILDGENCTLIDALLGDPQCDGLQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8085 - protein, 566 aa, Artificial Sequence
  hemagglutinin__InfluenzaA__AEX35527
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYVSLRSLVASSGTLEFNNESFNWTGVTQNGTSSACKRRSNNSFFSRLNWLTHLKFKYPALNVTMPNNEQFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8086 - protein, 566 aa, Artificial Sequence
  hemagglutinin__InfluenzaA__AEX35549
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRGSNNSFFSRLNWLTHLKFKYPALNVTMPNNEEFDKLYIWGVHHPGTDNDQISLYAQASGKITVSTKRSQQTVIPNIGSRPRVRDIPSRISIYWTIVKPGDILLINSTGNLIAPRGYFKIRSGKSSIMRSDAPIDKCNSECITPNGSIPNDKPFQNVNKITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8087 - protein, 566 aa, Artificial Sequence
  hemagglutinin__InfluenzaA__AEX35560
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYVSLRSLVASSGTLEFNNESFNWTGVTQNGTSSACKRRSNNSFFSRLNWLTHLKFKYPALNVTMPNNEQFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSVGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8088 - protein, 566 aa, Artificial Sequence
  hemagglutinin__InfluenzaA__AEX35571
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSRAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8089 - protein, 566 aa, Artificial Sequence; identical to SEQ ID NO: 630
  hemagglutinin__InfluenzaA__AEX35582

SEQ ID NO: 8090 - protein, 566 aa, Artificial Sequence
  hemagglutinin__InfluenzaA__AEX35593
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPLGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8091 - protein, 566 aa, Artificial Sequence; identical to SEQ ID NO: 2372
  hemagglutinin__InfluenzaA__AEX35604

SEQ ID NO: 8092 - protein, 566 aa, Artificial Sequence
  hemagglutinin__InfluenzaA__AEX35615
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYIEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8093 - protein, 566 aa, Artificial Sequence; identical to SEQ ID NO: 2434
  hemagglutinin__InfluenzaA__AEX35626

SEQ ID NO: 8094 - protein, 566 aa, Artificial Sequence
  hemagglutinin__InfluenzaA__AEX35637
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSDNSFFSKLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8095 - protein, 566 aa, Artificial Sequence; identical to SEQ ID NO: 2434
  hemagglutinin__InfluenzaA__AEX35648

SEQ ID NO: 8096 - protein, 566 aa, Artificial Sequence
  hemagglutinin__InfluenzaA__AEX36102
MKTIIALSYILCLVFAQKLPGNNNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8097 - protein, 566 aa, Artificial Sequence; identical to SEQ ID NO: 1915
  hemagglutinin__InfluenzaA__AEX36113

SEQ ID NO: 8098 - protein, 566 aa, Artificial Sequence; identical to SEQ ID NO: 2434
  hemagglutinin__InfluenzaA__AEX36124

SEQ ID NO: 8099 - protein, 566 aa, Artificial Sequence
  hemagglutinin__InfluenzaA__AEX36146
MKTIIALSYILCLVLAQKLPGDDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8100 - protein, 566 aa, Artificial Sequence
  hemagglutinin__InfluenzaA__AEX36168
MKTIIALSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRGSDNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNKLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFKIKGVELKSGYKDWILWISFAISCFLLCVALLGFIMWACQKGNIKCNICI

SEQ ID NO: 8101 - protein, 566 aa, Artificial Sequence; identical to SEQ ID NO: 2434
  hemagglutinin__InfluenzaA__AEX36179

SEQ ID NO: 8102 - protein, 566 aa, Artificial Sequence; identical to SEQ ID NO: 7983
  hemagglutinin__InfluenzaA__AEX36190

SEQ ID NO: 8103 - protein, 566 aa, Artificial Sequence; identical to SEQ ID NO: 7978
  hemagglutinin__InfluenzaA__AEX36201

SEQ ID NO: 8104 - protein, 566 aa, Artificial Sequence
  hemagglutinin__InfluenzaA__AEX36212
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKISQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8105 - protein, 566 aa, Artificial Sequence; identical to SEQ ID NO: 7978
  hemagglutinin__InfluenzaA__AEX36223

SEQ ID NO: 8106 - protein, 566 aa, Artificial Sequence
  hemagglutinin__InfluenzaA__AEX36234
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSDNSFFSKLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCLKIYHKCDNACIGSIRNGTYDHDVYRDEALNNRFQIKGVELKSGYKDWILWISFAISCFLLCVALLGFIMWACQKGNIRCNICI

SEQ ID NO: 8107 - protein, 566 aa, Artificial Sequence
  hemagglutinin__InfluenzaA__AEX36245
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKTYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8108 - protein, 566 aa, Artificial Sequence
  hemagglutinin__InfluenzaA__AEX36256
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRKSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8109 - protein, 566 aa, Artificial Sequence; identical to SEQ ID NO: 7978
  hemagglutinin__InfluenzaA__AEX36267

SEQ ID NO: 8110 - protein, 566 aa, Artificial Sequence
  hemagglutinin__InfluenzaA__AEX36289
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKISQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGYRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKLGYKDWILWISFAISCFLLCVALLGFIMWACQKGNIRCNICI

SEQ ID NO: 8111 - protein, 566 aa, Artificial Sequence
  hemagglutinin__InfluenzaA__AEX36300
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFSNESFNWTGVTQNGTSSACKRGSNNSFFSKLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8112 - protein, 566 aa, Artificial Sequence
  hemagglutinin__InfluenzaA__AEX36311
MKTIIALSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRGSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8113 - protein, 566 aa, Artificial Sequence
  hemagglutinin__InfluenzaA__AEX36322
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFPYAQASGRITVSTKISQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 8114 - protein, 566 aa, Artificial Sequence
  hemagglutinin__InfluenzaA__AEX36333
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDAYRDEALNNRFQIKGVELKSGYKDWILWISFAISCFLLCVALLGFIMWACQKGNIRCNICI

SEQ ID NO: 8115 - protein, 566 aa, Artificial Sequence
  hemagglutinin__InfluenzaA__AEX36344
MKTIIALSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSNAYSNCYPYDVPDYASLRSLVASSGTLEFNNESFNWAGVTQNGTSSACKRGSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 8116 - protein, 566 aa, Artificial Sequence
  hemagglutinin__InfluenzaA__AEX36366
MKTIIALSYILCLVFAQKLSGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8117 - protein, 566 aa, Artificial Sequence; identical to SEQ ID NO: 1928
  hemagglutinin__InfluenzaA__AEX36377

SEQ ID NO: 8118 - protein, 566 aa, Artificial Sequence
  hemagglutinin__InfluenzaA__AEX36388
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8119 - protein, 566 aa, Artificial Sequence
  hemagglutinin__InfluenzaA__AEX36399
MKTIIALSYILCLVFAQKLPGNDNSTATLCLGHHAVPNGTIVKTITNDQTEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8120 - protein, 566 aa, Artificial Sequence
  hemagglutinin__InfluenzaA__AEX36410
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8121 - protein, 566 aa, Artificial Sequence; identical to SEQ ID NO: 2434
  hemagglutinin__InfluenzaA__AEX36421

SEQ ID NO: 8122 - protein, 566 aa, Artificial Sequence
  hemagglutinin__InfluenzaA__AEX36432
MKTIIALSYILCLVFAQKLPGNDNSTATLCLGHHAVPNGTIVKTITNDQIEVTNATELVQSSSTGEICDSPHQVLDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8123 - protein, 566 aa, Artificial Sequence
  hemagglutinin__InfluenzaA__AEX36443
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8124 - protein, 566 aa, Artificial Sequence
  hemagglutinin__InfluenzaA__AEX36454
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8125 - protein, 566 aa, Artificial Sequence; identical to SEQ ID NO: 1729
  hemagglutinin__InfluenzaA__AEX36465

SEQ ID NO: 8126 - protein, 566 aa, Artificial Sequence
  hemagglutinin__InfluenzaA__AEX36476
MKTIIALSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFPYAQASGRITVSTKRSQQTVIPNIGSRPRIRNIPSRISIYWTIVKPGDILLINSTGNLIAPRGYFKIRSGKSSIMRSDAPIGKCDSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8127 - protein, 566 aa, Artificial Sequence
  hemagglutinin__InfluenzaA__AEX36487
MKTIIALSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVLHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8128 - protein, 566 aa, Artificial Sequence; identical to SEQ ID NO: 7978
  hemagglutinin__InfluenzaA__AEX36498

SEQ ID NO: 8129 - protein, 566 aa, Artificial Sequence
  hemagglutinin__InfluenzaA__AEX36509
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8130 - protein, 566 aa, Artificial Sequence
  hemagglutinin__InfluenzaA__AEX36520
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 8131 - protein, 566 aa, Artificial Sequence
  hemagglutinin__InfluenzaA__AEX36531
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLDKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8132 - protein, 566 aa, Artificial Sequence
  hemagglutinin__InfluenzaA__AEX36542
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8133 - protein, 566 aa, Artificial Sequence; identical to SEQ ID NO: 8132
  hemagglutinin__InfluenzaA__AEX36553

SEQ ID NO: 8134 - protein, 566 aa, Artificial Sequence; identical to SEQ ID NO: 8132
  hemagglutinin__InfluenzaA__AEX36564

SEQ ID NO: 8135 - protein, 566 aa, Artificial Sequence
  hemagglutinin__InfluenzaA__AEX36575
MKTIIALSYILCLVFAQKLPGNGNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDIWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8136 - protein, 566 aa, Artificial Sequence
  hemagglutinin__InfluenzaA__AEX36586
MKTIIALSYILCLVFAQKLPGNDNNTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8137 - protein, 566 aa, Artificial Sequence
  hemagglutinin__InfluenzaA__AEX36597
MKTIIALSYILCLVFAQKLPGNDNSMATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKVDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8138 - protein, 566 aa, Artificial Sequence
  hemagglutinin__InfluenzaA__AEX36608
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNENFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNKRFQIKGVELKSGYKDWILWISFAISCFLLCVALLGFIMWACQKGNIRCNICI

SEQ ID NO: 8139 - protein, 566 aa, Artificial Sequence; identical to SEQ ID NO: 7961
  hemagglutinin__InfluenzaA__AEX36619

SEQ ID NO: 8140 - protein, 566 aa, Artificial Sequence
  hemagglutinin__InfluenzaA__AEX63617
MEAKLFVLFCAFTALKADTICVGYHANNSTDTVDTILEKNVTVTHSVNLLENSHNGKLCSLNGKIPLQLGNCNVAGWILGNPKCDLLLTANSWSYIIETSNSKNGACYPGEFADYEELKEQLSTVSSFERFEIFPKATSWPNHDTTRGTTVACSHSGANSFYRNLLWIVKKGNSYPKLSKSYTNNKGKEVLVIWGVHHPPTDSVQQTLYQNNHTYVSVGSSKYYKRFTPEIVARPKVREQAGRMNYYWTLLDQGDTITFEATGNLIAPWHAFALKKGSSSGIMRSDAQVHNCTTKCQTPHGALKGNLPFQNVHPVTIGECPKYVKSTQLRMATGLRNIPSIQSRGLFGAIAGFIEGGWTGMVDGWYGYHHRNEQGSGYAADQKSTQIAIDGISNKVNSVIEKMNIQFTSVGKEFNSLEKRMENLNKKVDDGFLDVWTYNAELLILLENERTLDFHDLNVKNLYEKVKSQLRNNAKEIGNGCFEFYHKCDNECMESVKNGTYNYLKYSEESKLNREEIDGVKLESMGIHQILAIYSTVASSLVLLVSLGAISFWMCSNGSLQCRVCI

SEQ ID NO: 8141 - protein, 565 aa, Artificial Sequence; identical to SEQ ID NO: 3278
  hemagglutinin__InfluenzaA__AEX92873

SEQ ID NO: 8142 - protein, 566 aa, Artificial Sequence; identical to SEQ ID NO: 3833
  hemagglutinin__InfluenzaA__AEY69088

SEQ ID NO: 8143 - protein, 566 aa, Artificial Sequence; identical to SEQ ID NO: 3430
  hemagglutinin__InfluenzaA__AEY69098

SEQ ID NO: 8144 - protein, 566 aa, Artificial Sequence; identical to SEQ ID NO: 3411
  hemagglutinin__InfluenzaA__AEY69120

SEQ ID NO: 8145 - protein, 566 aa, Artificial Sequence; identical to SEQ ID NO: 3613
  hemagglutinin__InfluenzaA__AEY69131

SEQ ID NO: 8146 - protein, 566 aa, Artificial Sequence; identical to SEQ ID NO: 6988
  hemagglutinin__InfluenzaA__AEY69153

SEQ ID NO: 8147 - protein, 566 aa, Artificial Sequence; identical to SEQ ID NO: 3613
  hemagglutinin__InfluenzaA__AEY69164

SEQ ID NO: 8148 - protein, 566 aa, Artificial Sequence; identical to SEQ ID NO: 3613
  hemagglutinin__InfluenzaA__AEY69175

SEQ ID NO: 8149 - protein, 566 aa, Artificial Sequence; identical to SEQ ID NO: 3613
  hemagglutinin__InfluenzaA__AEY69186

SEQ ID NO: 8150 - protein, 566 aa, Artificial Sequence; identical to SEQ ID NO: 3613
  hemagglutinin__InfluenzaA__AEY69197

SEQ ID NO: 8151 - protein, 566 aa, Artificial Sequence; identical to SEQ ID NO: 3613
  hemagglutinin__InfluenzaA__AEY69208

SEQ ID NO: 8152 - protein, 566 aa, Artificial Sequence; identical to SEQ ID NO: 3613
  hemagglutinin__InfluenzaA__AEY69219

SEQ ID NO: 8153 - protein, 566 aa, Artificial Sequence; identical to SEQ ID NO: 3411
  hemagglutinin__InfluenzaA__AEY69258

SEQ ID NO: 8154 - protein, 566 aa, Artificial Sequence; identical to SEQ ID NO: 3613
  hemagglutinin__InfluenzaA__AEY69269

SEQ ID NO: 8155 - protein, 566 aa, Artificial Sequence; identical to SEQ ID NO: 3411
  hemagglutinin__InfluenzaA__AEY69291

SEQ ID NO: 8156 - protein, 566 aa, Artificial Sequence; identical to SEQ ID NO: 3411
  hemagglutinin__InfluenzaA__AEY69302

SEQ ID NO: 8157 - protein, 566 aa, Artificial Sequence; identical to SEQ ID NO: 3411
  hemagglutinin__InfluenzaA__AEY69313

SEQ ID NO: 8158 - protein, 566 aa, Artificial Sequence; identical to SEQ ID NO: 3411
  hemagglutinin__InfluenzaA__AEY69785

SEQ ID NO: 8159 - protein, 566 aa, Artificial Sequence
  hemagglutinin__InfluenzaA__AEY69807
MKTIIALSYILCLVFAQKLPGNDNSTATLCLGHHAVPNGTIVKTITNDQIEVTNATELVQSSSTGEICDSPHQILDGKNCTLIDALLGDPQCDGLQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKLRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8160 - protein, 566 aa, Artificial Sequence; identical to SEQ ID NO: 3613
  hemagglutinin__InfluenzaA__AEY69818

SEQ ID NO: 8161 - protein, 566 aa, Artificial Sequence; identical to SEQ ID NO: 3613
  hemagglutinin__InfluenzaA__AEY69829

SEQ ID NO: 8162 - protein, 566 aa, Artificial Sequence; identical to SEQ ID NO: 3613
  hemagglutinin__InfluenzaA__AEY69840

SEQ ID NO: 8163 - protein, 566 aa, Artificial Sequence; identical to SEQ ID NO: 3613
  hemagglutinin__InfluenzaA__AEY69851

SEQ ID NO: 8164 - protein, 566 aa, Artificial Sequence; identical to SEQ ID NO: 3613
  hemagglutinin__InfluenzaA__AEY69873

SEQ ID NO: 8165 - protein, 566 aa, Artificial Sequence; identical to SEQ ID NO: 3613
  hemagglutinin__InfluenzaA__AEY69884

SEQ ID NO: 8166 - protein, 566 aa, Artificial Sequence; identical to SEQ ID NO: 3613
  hemagglutinin__InfluenzaA__AEY69895

SEQ ID NO: 8167 - protein, 566 aa, Artificial Sequence; identical to SEQ ID NO: 6988
  hemagglutinin__InfluenzaA__AEY69906

SEQ ID NO: 8168 - protein, 566 aa, Artificial Sequence; identical to SEQ ID NO: 3613
  hemagglutinin__InfluenzaA__AEY69917

SEQ ID NO: 8169 - protein, 566 aa, Artificial Sequence
  hemagglutinin__InfluenzaA__AEY69939
MKTIIALSYILCLVFAQKIPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSGCITPNGSIPNDKPFQNVNRITYGVCPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWFLWISFAISCFLLCVALLGFIMWACQKGNIRCNICI

SEQ ID NO: 8170 - protein, 566 aa, Artificial Sequence; identical to SEQ ID NO: 8169
  hemagglutinin__InfluenzaA__AEY69950

SEQ ID NO: 8171 - protein, 566 aa, Artificial Sequence; identical to SEQ ID NO: 8169
  hemagglutinin__InfluenzaA__AEY69961

SEQ ID NO: 8172 - protein, 566 aa, Artificial Sequence
  hemagglutinin__InfluenzaA__AEY69994
MKTIIALSYILCLVFAQKIPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSGCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWFLWISFAISCFLLCVALLGFIMWACQKGNIRCNICI

SEQ ID NO: 8173 - protein, 566 aa, Artificial Sequence; identical to SEQ ID NO: 8172
  hemagglutinin__InfluenzaA__AEY70005

SEQ ID NO: 8174 - protein, 566 aa, Artificial Sequence; identical to SEQ ID NO: 3613
  hemagglutinin__InfluenzaA__AEY70016

SEQ ID NO: 8175 - protein, 566 aa, Artificial Sequence
  hemagglutinin__InfluenzaA__AEY70256
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYGNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDMLLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8176 - protein, 566 aa, Artificial Sequence; identical to SEQ ID NO: 3613
  hemagglutinin__InfluenzaA__AEY70267

SEQ ID NO: 8177 - protein, 566 aa, Artificial Sequence; identical to SEQ ID NO: 3613
  hemagglutinin__InfluenzaA__AEY70278

SEQ ID NO: 8178 - protein, 566 aa, Artificial Sequence; identical to SEQ ID NO: 3411
  hemagglutinin__InfluenzaA__AEY70289

SEQ ID NO: 8179 - protein, 566 aa, Artificial Sequence; identical to SEQ ID NO: 3613
  hemagglutinin__InfluenzaA__AEY70300

SEQ ID NO: 8180 - protein, 566 aa, Artificial Sequence; identical to SEQ ID NO: 3613
  hemagglutinin__InfluenzaA__AEY70311

SEQ ID NO: 8181 - protein, 566 aa, Artificial Sequence; identical to SEQ ID NO: 3613
  hemagglutinin__InfluenzaA__AEY70333

SEQ ID NO: 8182 - protein, 566 aa, Artificial Sequence; identical to SEQ ID NO: 8172
  hemagglutinin__InfluenzaA__AEY70344

SEQ ID NO: 8183 - protein, 566 aa, Artificial Sequence; identical to SEQ ID NO: 5224
  hemagglutinin__InfluenzaA__AEY70355

SEQ ID NO: 8184 - protein, 566 aa, Artificial Sequence; identical to SEQ ID NO: 3411
  hemagglutinin__InfluenzaA__AEY70365

SEQ ID NO: 8185 - protein, 566 aa, Artificial Sequence; identical to SEQ ID NO: 3613
  hemagglutinin__InfluenzaA__AEY70376

SEQ ID NO: 8186 - protein, 566 aa, Artificial Sequence
  hemagglutinin__InfluenzaA__AFB18656
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 8187 - protein, 566 aa, Artificial Sequence; identical to SEQ ID NO: 7050
  hemagglutinin__InfluenzaA__AFB40597

SEQ ID NO: 8188 - protein, 566 aa, Artificial Sequence; identical to SEQ ID NO: 7050
  hemagglutinin__InfluenzaA__AFB40598

SEQ ID NO: 8189 - protein, 566 aa, Artificial Sequence
  hemagglutinin__InfluenzaA__AFB40599
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDLNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8190 - protein, 566 aa, Artificial Sequence; identical to SEQ ID NO: 3833
  hemagglutinin__InfluenzaA__AFB40600

SEQ ID NO: 8191 - protein, 566 aa, Artificial Sequence
  hemagglutinin__InfluenzaA__AFB40601
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPETSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8192 - protein, 566 aa, Artificial Sequence; identical to SEQ ID NO: 2669
  hemagglutinin__InfluenzaA__AFB40602

SEQ ID NO: 8193 - protein, 566 aa, Artificial Sequence; identical to SEQ ID NO: 3833
  hemagglutinin__InfluenzaA__AFB40603

SEQ ID NO: 8194 - protein, 566 aa, Artificial Sequence
  hemagglutinin__InfluenzaA__AFB40604
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKEGNSYPKLSKSYINDKGKEVLVLWGIHHPPTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVDKEFNHLEKRIGNLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8195 - protein, 566 aa, Artificial Sequence; identical to SEQ ID NO: 2669
  hemagglutinin__InfluenzaA__AFB70138

SEQ ID NO: 8196 - protein, 566 aa, Artificial Sequence
  hemagglutinin__InfluenzaA__AFB70145
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGITAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8197 - protein, 566 aa, Artificial Sequence
  hemagglutinin__InfluenzaA__AFB70154
MKAILVVLLYTFATANADTLCIGYHANNSTDTVDTVLEKNVTVTHSVNLLEDKHNEKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8198 - protein, 566 aa, Artificial Sequence; identical to SEQ ID NO: 2669
  hemagglutinin__InfluenzaA__AFB70156

SEQ ID NO: 8199 - protein, 566 aa, Artificial Sequence; identical to SEQ ID NO: 2669
  hemagglutinin__InfluenzaA__AFB70158

SEQ ID NO: 8200 - protein, 566 aa, Artificial Sequence; identical to SEQ ID NO: 8196
  hemagglutinin__InfluenzaA__AFB70160

SEQ ID NO: 8201 - protein, 566 aa, Artificial Sequence; identical to SEQ ID NO: 3863
  hemagglutinin__InfluenzaA__AFB70162

SEQ ID NO: 8202 - protein, 566 aa, Artificial Sequence
  hemagglutinin__InfluenzaA__AFB70167
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAMRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8203 - protein, 566 aa, Artificial Sequence; identical to SEQ ID NO: 2669
  hemagglutinin__InfluenzaA__AFB70177

SEQ ID NO: 8204 - protein, 566 aa, Artificial Sequence; identical to SEQ ID NO: 3238
  hemagglutinin__InfluenzaA__AFB70187

SEQ ID NO: 8205 - protein, 566 aa, Artificial Sequence; identical to SEQ ID NO: 3863
  hemagglutinin__InfluenzaA__AFB70197

SEQ ID NO: 8206 - protein, 566 aa, Artificial Sequence; identical to SEQ ID NO: 2669
  hemagglutinin__InfluenzaA__AFB70207

SEQ ID NO: 8207 - protein, 566 aa, Artificial Sequence; identical to SEQ ID NO: 2669
  hemagglutinin__InfluenzaA__AFB70217

SEQ ID NO: 8208 - protein, 566 aa, Artificial Sequence; identical to SEQ ID NO: 2669
  hemagglutinin__InfluenzaA__AFB70227

SEQ ID NO: 8209 - protein, 566 aa, Artificial Sequence
  hemagglutinin__InfluenzaA__AFB70247
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKEFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8210 - protein, 566 aa, Artificial Sequence
  hemagglutinin__InfluenzaA__AFB70257
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFVDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8211 - protein, 566 aa, Artificial Sequence; identical to SEQ ID NO: 7076
  hemagglutinin__InfluenzaA__AFB70267

SEQ ID NO: 8212 - protein, 566 aa, Artificial Sequence; identical to SEQ ID NO: 3139
  hemagglutinin__InfluenzaA__AFB70277

SEQ ID NO: 8213 - protein, 566 aa, Artificial Sequence; identical to SEQ ID NO: 2669
  hemagglutinin__InfluenzaA__AFB70287

SEQ ID NO: 8214 - protein, 566 aa, Artificial Sequence; identical to SEQ ID NO: 2669
  hemagglutinin__InfluenzaA__AFB70297

SEQ ID NO: 8215 - protein, 566 aa, Artificial Sequence; identical to SEQ ID NO: 2669
  hemagglutinin__InfluenzaA__AFB70307

SEQ ID NO: 8216 - protein, 566 aa, Artificial Sequence; identical to SEQ ID NO: 8196
  hemagglutinin__InfluenzaA__AFB70317

SEQ ID NO: 8217 - protein, 566 aa, Artificial Sequence
  hemagglutinin__InfluenzaA__AFB70327
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLGKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8218 - protein, 566 aa, Artificial Sequence; identical to SEQ ID NO: 2669
  hemagglutinin__InfluenzaA__AFB70337

SEQ ID NO: 8219 - protein, 566 aa, Artificial Sequence; identical to SEQ ID NO: 4639
  hemagglutinin__InfluenzaA__AFB70347

SEQ ID NO: 8220 - protein, 566 aa, Artificial Sequence; identical to SEQ ID NO: 2669
  hemagglutinin__InfluenzaA__AFB70367

SEQ ID NO: 8221 - protein, 566 aa, Artificial Sequence; identical to SEQ ID NO: 2669
  hemagglutinin__InfluenzaA__AFB70377

SEQ ID NO: 8222 - protein, 566 aa, Artificial Sequence; identical to SEQ ID NO: 3238
  hemagglutinin__InfluenzaA__AFB70387

SEQ ID NO: 8223 - protein, 566 aa, Artificial Sequence; identical to SEQ ID NO: 2669
  hemagglutinin__InfluenzaA__AFB70397

SEQ ID NO: 8224 - protein, 566 aa, Artificial Sequence; identical to SEQ ID NO: 2669
  hemagglutinin__InfluenzaA__AFB70407

SEQ ID NO: 8225 - protein, 566 aa, Artificial Sequence
  hemagglutinin__InfluenzaA__AFB77618
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPTTTGDQQSLYQNADGYVFVGTTRYSKKFKPEIGIRPKVKDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVMVVSLGAISFWMCSNGSLQCRICI

SEQ ID NO: 8226 - protein, 566 aa, Artificial Sequence; identical to SEQ ID NO: 6867
  hemagglutinin__InfluenzaA__AFB77619

SEQ ID NO: 8227 - protein, 566 aa, Artificial Sequence; identical to SEQ ID NO: 6867
  hemagglutinin__InfluenzaA__AFB77620

SEQ ID NO: 8228 - protein, 566 aa, Artificial Sequence
  hemagglutinin__InfluenzaA__AFB77621
MKAILVVLLYTFATANADTLCIGYHANNSTDTVDTVLEKNVTVTHSVNLLEDKHNGKLCKLRGVTPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8229 - protein, 566 aa, Artificial Sequence
  hemagglutinin__InfluenzaA__AFB77622
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDPNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8230 - protein, 566 aa, Artificial Sequence; identical to SEQ ID NO: 6867
  hemagglutinin__InfluenzaA__AFB77623

SEQ ID NO: 8231 - protein, 566 aa, Artificial Sequence; identical to SEQ ID NO: 6867
  hemagglutinin__InfluenzaA__AFB77624

SEQ ID NO: 8232 - protein, 566 aa, Artificial Sequence
  hemagglutinin__InfluenzaA__AFB77625
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8233 - protein, 566 aa, Artificial Sequence
  hemagglutinin__InfluenzaA__AFB77627
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFSKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8234 - protein, 566 aa, Artificial Sequence; identical to SEQ ID NO: 6867
  hemagglutinin__InfluenzaA__AFB77628

SEQ ID NO: 8235 - protein, 566 aa, Artificial Sequence
  hemagglutinin__InfluenzaA__AFB77629
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNEELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8236 - protein, 566 aa, Artificial Sequence
  hemagglutinin__InfluenzaA__AFB77630
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHESNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8237 - protein, 566 aa, Artificial Sequence
  hemagglutinin__InfluenzaA__AFB77631
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8238 - protein, 566 aa, Artificial Sequence
  hemagglutinin__InfluenzaA__AFB77632
MKAILVVLLYTFATANADTLCIGYHANNSTDTVDTVLEKNVTVTHSVNLLEDKHNGKLCKLRGVAPLHLGKCNIAGWILGNPECESLTTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCKICI

SEQ ID NO: 8239 - protein, 566 aa, Artificial Sequence
  hemagglutinin__InfluenzaA__AFB77633
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACSHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVKNQLKNNAKEIGNGCFEFYHKCDNTPIKNVKNGTYDYPKYSEEAKLNREEIDGVKLESTRIYQILAIYSTVASSLVLVVSLGAISFWMCSNGSLQCRICI

SEQ ID NO: 8240 - protein, 566 aa, Artificial Sequence
  hemagglutinin__InfluenzaA__AFB77634
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGEKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8241 - protein, 566 aa, Artificial Sequence
  hemagglutinin__InfluenzaA__AFB77635
MKAILVVLLYTFATANADTLCIGYHANNSTDTVDTVLEKNVTVTHSVNLLEDKHNGKLCKLRGVAPLHLGKCNIAGWILGNPECESLSTASPWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8242 - protein, 566 aa, Artificial Sequence
  hemagglutinin__InfluenzaA__AFB77636
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERKAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVMVVSLGAISFWMCSNGSLQCRICI

SEQ ID NO: 8243 - protein, 566 aa, Artificial Sequence
  hemagglutinin__InfluenzaA__AFB77637
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKGRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8244 - protein, 566 aa, Artificial Sequence
  hemagglutinin__InfluenzaA__AFB77638
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKFYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8245 - protein, 566 aa, Artificial Sequence; identical to SEQ ID NO: 6867
  hemagglutinin__InfluenzaA__AFB77639

SEQ ID NO: 8246 - protein, 566 aa, Artificial Sequence
  hemagglutinin__InfluenzaA__AFB77640
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQGLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8247 - protein, 566 aa, Artificial Sequence
  hemagglutinin__InfluenzaA__AFB77641
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNMCMESVKNGTYDYPKYSEEAKLNREEIDGVKLESTRIYQILAIYSTVASSLVLVVSLGAISFWMCSNGSLQCRICI

SEQ ID NO: 8248 - protein, 566 aa, Artificial Sequence; identical to SEQ ID NO: 6867
  hemagglutinin__InfluenzaA__AFB77642

SEQ ID NO: 8249 - protein, 566 aa, Artificial Sequence
  hemagglutinin__InfluenzaA__AFB77643
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKPSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDDTKDSEEAKLNREEIDGVKLESTRIYQILAIYSTVASSLVLVVSLGAISFWMCSNGSLQCRICI

SEQ ID NO: 8250 - protein, 566 aa, Artificial Sequence
  hemagglutinin__InfluenzaA__AFB77691
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFEKLYIWGVHHPGTDKDQIFLYAQASGRITVSTKRSQQAVIPNIGSRLRVRNIPSRISIYWTIVKPGDILLINSTGNLNAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKNQLRENAEDMGNGCFKIYHKCDNTCIGSIRNGTYDHDAYRDEALNNRFQIKGVELKSGYKDWILWISFAISCFLLCVALLGFIMWACQKGNIRCNICI

SEQ ID NO: 8251 - protein, 566 aa, Artificial Sequence
  hemagglutinin__InfluenzaA__AFB77692
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNTGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8252 - protein, 566 aa, Artificial Sequence; identical to SEQ ID NO: 7782
  hemagglutinin__InfluenzaA__AFB77693

SEQ ID NO: 8253 - protein, 566 aa, Artificial Sequence
  hemagglutinin__InfluenzaA__AFB77694
MKTIIALSYILCLVFAQKLPGNDNSTATLCLGHHAVPNGTIVKTIANDQIEVTNATELVQNSSTGEICDSPHQILDGENCTLIDALLGDPQCDDFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNTCIGSIRNGTYDHDVYRDEALNNRFQIKGVELKSGYKDWILWISFAISCFLLCVALLGFIMWACQKGNIRCNICI

SEQ ID NO: 8254 - protein, 566 aa, Artificial Sequence
  hemagglutinin__InfluenzaA__AFB77695
MKTIIALSYILCLVFAQKLPGNDNSTATLCLGHHAVPNGTIVKTITNDQIEVTNATELVQNSSTGEICDSPHQILDGENCTLIDALLGDPQCDDFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8255 - protein, 566 aa, Artificial Sequence
  hemagglutinin__InfluenzaA__AFB78126
MKTIIALSYILCLVFAQKLPGNDNSTATLCLGHHAVSNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQDGTSSACKRRSNKSFFSRLNWLHQLKYKYPALNVTMPNNEKFDKLYIWGVHHPSTDSDQISIYAQASGRVTVSTKRSQQTVIPNIGSSPWVRGASSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAATNQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8256 - protein, 566 aa, Artificial Sequence
  hemagglutinin__InfluenzaA__AFC34056
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQRTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 8257 - protein, 566 aa, Artificial Sequence; identical to SEQ ID NO: 8256
  hemagglutinin__InfluenzaA__AFC34057

SEQ ID NO: 8258 - protein, 566 aa, Artificial Sequence
  hemagglutinin__InfluenzaA__AFD32426
MKANLLVLLSALAAADADTICIGYHANNSTDTVDTVLEKNVTVTHSVNLLEDSHNGKLCKLRGVAPLHLGKCNIAGRILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTKCQTPLGAINSSLPYQNIHPVTIGECPKYVRSAKLRMVTGLRNTPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 8259 - protein, 565 aa, Artificial Sequence
  hemagglutinin__InfluenzaA__AFD32427
MKANLLVLLSALAAADADTICIGYHANNSTDTVDTVLEKNVTVTHSVNLLEDSHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPLGAINSSLPYQNIHPVTIGECPKYVRSAKLRMVTGLRNTPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 8260 - protein, 573 aa, Artificial Sequence
  hemagglutinin__InfluenzaA__AFD32428
MKTIIALSYILCLVFAQKLPGNDNSTATLCLGHHAVPNGTIVKTITNDQIEVTNATELVQSSSTGEICDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8261 - protein, 567 aa, Artificial Sequence
  hemagglutinin__InfluenzaA__AFD32429
MKTIIALSYILCLVFAQKLPGNDNSTATLCLGHHAVPNGTIVKTITNDQIEVTNATELVQSSSTGEICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAEFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8262 - protein, 566 aa, Artificial Sequence; identical to SEQ ID NO: 73
  hemagglutinin__InfluenzaA__AFD63527

SEQ ID NO: 8263 - protein, 566 aa, Artificial Sequence
  hemagglutinin__InfluenzaA__AFD63538
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSIVASSGTLEFNNESFNWTGVTQNGTSSACKRKSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRYQIKGVELKSGYKDWILWISFAISCFLLCVALLGFIMWACQKGNIRCNICI

SEQ ID NO: 8264 - protein, 566 aa, Artificial Sequence
  hemagglutinin__InfluenzaA__AFD63549
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8265 - protein, 566 aa, Artificial Sequence; identical to SEQ ID NO: 73
  hemagglutinin__InfluenzaA__AFD63571

SEQ ID NO: 8266 - protein, 566 aa, Artificial Sequence
  hemagglutinin__InfluenzaA__AFD63615
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEERIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8267 - protein, 566 aa, Artificial Sequence
  hemagglutinin__InfluenzaA__AFD63626
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8268 - protein, 566 aa, Artificial Sequence
  hemagglutinin__InfluenzaA__AFD63637
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSTCKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8269 - protein, 566 aa, Artificial Sequence
  hemagglutinin__InfluenzaA__AFD63648
MKTIIALSYILCLVFAQKLPGNDNSMATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8270 - protein, 566 aa, Artificial Sequence; identical to SEQ ID NO: 73
  hemagglutinin__InfluenzaA__AFD63659

SEQ ID NO: 8271 - protein, 566 aa, Artificial Sequence
  hemagglutinin__InfluenzaA__AFD63681
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKVRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8272 - protein, 566 aa, Artificial Sequence
  hemagglutinin__InfluenzaA__AFD63692
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVLHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8273 - protein, 566 aa, Artificial Sequence
  hemagglutinin__InfluenzaA__AFD63703
MKTIIALSYILCLVFAQKLPGNDNSTATLCLGHHAVPNGTIVKTITNDQIEVTNATELVQISSTSGICDSPYQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSQISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8274 - protein, 566 aa, Artificial Sequence
  hemagglutinin__InfluenzaA__AFD63714
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSTCKRRSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQQTIDLTDSEMNKLFERTKKQLRENAEDMGNGCFKIYHKCDNACIGSIRNGTYDHDVYRDEALNNRFHIKGVELKSGYKDWILWISFAISCFLLCVALLGFIMWACQKGNIRCNICI

SEQ ID NO: 8275 - protein, 566 aa, Artificial Sequence
  hemagglutinin__InfluenzaA__AFD63736
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSTCKRRSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFHIKGVELKSGYKDWILWISFAISCFLLCVALLGFIMWACQKGNIRCNICI

SEQ ID NO: 8276 - protein, 566 aa, Artificial Sequence
  hemagglutinin__InfluenzaA__AFD63747
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHRIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8277 - protein, 566 aa, Artificial Sequence
  hemagglutinin__InfluenzaA__AFD63758
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8278 - protein, 566 aa, Artificial Sequence
  hemagglutinin__InfluenzaA__AFD63769
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFHIKSVELKSGYKDWILWISFAISCFLLCVALLGFIMWACQKGNIRCNICI

SEQ ID NO: 8279 - protein, 566 aa, Artificial Sequence; identical to SEQ ID NO: 73
  hemagglutinin__InfluenzaA__AFD63780

SEQ ID NO: 8280 - protein, 566 aa, Artificial Sequence; identical to SEQ ID NO: 8277
  hemagglutinin__InfluenzaA__AFD63791

SEQ ID NO: 8281 - protein, 566 aa, Artificial Sequence; identical to SEQ ID NO: 73
  hemagglutinin__InfluenzaA__AFD63802

SEQ ID NO: 8282 - protein, 566 aa, Artificial Sequence
  hemagglutinin__InfluenzaA__AFD63813
MKTIIALSYILSLVFAQKFPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGSLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFATSCFLLCVALLGFIMWACQKGNIRCNICI

SEQ ID NO: 8283 - protein, 566 aa, Artificial Sequence; identical to SEQ ID NO: 8267
  hemagglutinin__InfluenzaA__AFD63824

SEQ ID NO: 8284 - protein, 566 aa, Artificial Sequence; identical to SEQ ID NO: 73
  hemagglutinin__InfluenzaA__AFD63846

SEQ ID NO: 8285 - protein, 566 aa, Artificial Sequence; identical to SEQ ID NO: 1311
  hemagglutinin__InfluenzaA__AFD63857

SEQ ID NO: 8286 - protein, 566 aa, Artificial Sequence; identical to SEQ ID NO: 73
  hemagglutinin__InfluenzaA__AFD63868

SEQ ID NO: 8287 - protein, 566 aa, Artificial Sequence; identical to SEQ ID NO: 73
  hemagglutinin__InfluenzaA__AFD63890

SEQ ID NO: 8288 - protein, 566 aa, Artificial Sequence; identical to SEQ ID NO: 73
  hemagglutinin__InfluenzaA__AFD63901

SEQ ID NO: 8289 - protein, 566 aa, Artificial Sequence; identical to SEQ ID NO: 73
  hemagglutinin__InfluenzaA__AFD63912

SEQ ID NO: 8290 - protein, 566 aa, Artificial Sequence
  hemagglutinin__InfluenzaA__AFD63923
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSNKSFFSRLNWLTHLKYKYPALNVTMPNNEKFDKLYIWGVHHPGTDNDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8291 - protein, 566 aa, Artificial Sequence
  hemagglutinin__InfluenzaA__AFD63934
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTESDQISLYAQASGRITVSTKRSQQTVIPNIGSRPRVRDVSSRISIYWTVVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8292 - protein, 566 aa, Artificial Sequence; identical to SEQ ID NO: 8267
  hemagglutinin__InfluenzaA__AFD63945

SEQ ID NO: 8293 - protein, 566 aa, Artificial Sequence; identical to SEQ ID NO: 8267
  hemagglutinin__InfluenzaA__AFD63956

SEQ ID NO: 8294 - protein, 566 aa, Artificial Sequence; identical to SEQ ID NO: 8267
  hemagglutinin__InfluenzaA__AFD63967

SEQ ID NO: 8295 - protein, 566 aa, Artificial Sequence; identical to SEQ ID NO: 73
  hemagglutinin__InfluenzaA__AFD63989

SEQ ID NO: 8296 - protein, 566 aa, Artificial Sequence; identical to SEQ ID NO: 73
  hemagglutinin__InfluenzaA__AFD64000

SEQ ID NO: 8297 - protein, 566 aa, Artificial Sequence
  hemagglutinin__InfluenzaA__AFD64011
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQAPGKITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 8298 - protein, 566 aa, Artificial Sequence; identical to SEQ ID NO: 73
  hemagglutinin__InfluenzaA__AFD64022

SEQ ID NO: 8299 - protein, 566 aa, Artificial Sequence; identical to SEQ ID NO: 73
  hemagglutinin__InfluenzaA__AFD64033

SEQ ID NO: 8300 - protein, 566 aa, Artificial Sequence
  hemagglutinin__InfluenzaA__AFD64044
MKTIIALSYILCLVFAQKLPGNENSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8301 - protein, 566 aa, Artificial Sequence; identical to SEQ ID NO: 8277
  hemagglutinin__InfluenzaA__AFD64055

SEQ ID NO: 8302 - protein, 566 aa, Artificial Sequence
  hemagglutinin__InfluenzaA__AFD64066
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYTSLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNAEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKNWILWISFAISCFLLCVALLGFIMWACQKGNIRCNICI

SEQ ID NO: 8303 - protein, 566 aa, Artificial Sequence
  hemagglutinin__InfluenzaA__AFD64077
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRIRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8304 - protein, 566 aa, Artificial Sequence; identical to SEQ ID NO: 73
  hemagglutinin__InfluenzaA__AFD64088

SEQ ID NO: 8305 - protein, 566 aa, Artificial Sequence; identical to SEQ ID NO: 73
  hemagglutinin__InfluenzaA__AFD64099

SEQ ID NO: 8306 - protein, 566 aa, Artificial Sequence; identical to SEQ ID NO: 8277
  hemagglutinin__InfluenzaA__AFD64110

SEQ ID NO: 8307 - protein, 566 aa, Artificial Sequence
  hemagglutinin__InfluenzaA__AFD64121
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSRAYSNCYPYDVPDYASLRSLVASSGTLEFNNESFNWTGVTQNGTSSACKRKSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8308 - protein, 566 aa, Artificial Sequence; identical to SEQ ID NO: 73
  hemagglutinin__InfluenzaA__AFD64132

SEQ ID NO: 8309 - protein, 566 aa, Artificial Sequence; identical to SEQ ID NO: 8267
  hemagglutinin__InfluenzaA__AFD64143

SEQ ID NO: 8310 - protein, 566 aa, Artificial Sequence; identical to SEQ ID NO: 73
  hemagglutinin__InfluenzaA__AFD64154

SEQ ID NO: 8311 - protein, 566 aa, Artificial Sequence
  hemagglutinin__InfluenzaA__AFD64179
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSQISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8312 - protein, 566 aa, Artificial Sequence; identical to SEQ ID NO: 8311
  hemagglutinin__InfluenzaA__AFD64190

SEQ ID NO: 8313 - protein, 566 aa, Artificial Sequence; identical to SEQ ID NO: 8267
  hemagglutinin__InfluenzaA__AFD64201

SEQ ID NO: 8314 - protein, 566 aa, Artificial Sequence; identical to SEQ ID NO: 8277
  hemagglutinin__InfluenzaA__AFD64212

SEQ ID NO: 8315 - protein, 566 aa, Artificial Sequence
  hemagglutinin__InfluenzaA__AFD64223
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVLHPGTDSDQIRLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQYTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8316 - protein, 566 aa, Artificial Sequence
  hemagglutinin__InfluenzaA__AFD64315
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKNQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8317 - protein, 566 aa, Artificial Sequence; identical to SEQ ID NO: 8307
  hemagglutinin__InfluenzaA__AFD64326

SEQ ID NO: 8318 - protein, 566 aa, Artificial Sequence; identical to SEQ ID NO: 8277
  hemagglutinin__InfluenzaA__AFD64337

SEQ ID NO: 8319 - protein, 566 aa, Artificial Sequence; identical to SEQ ID NO: 73
  hemagglutinin__InfluenzaA__AFD64348

SEQ ID NO: 8320 - protein, 566 aa, Artificial Sequence; identical to SEQ ID NO: 8277
  hemagglutinin__InfluenzaA__AFD64359

SEQ ID NO: 8321 - protein, 566 aa, Artificial Sequence
  hemagglutinin__InfluenzaA__AFD64370
MKTIIALSYILCLVFAQKLPGNDNSTATLCLGHHAVPNGTIVKTITNDQIEVTNATELVQSSSTGGICDSPHQILDGENCTLIDALLGDPHCDGFQNKKWDLFVERSKAYSNCYPYDVPDYASLRSLVASSGTLEFNNESFNWTGVTQNGTSSACKRKSNKSFFSRLNWLTHLKYKYPALNVTMPNNEKFDKLYIWGVHHPGTDNDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8322 - protein, 566 aa, Artificial Sequence; identical to SEQ ID NO: 73
  hemagglutinin__InfluenzaA__AFD64381

SEQ ID NO: 8323 - protein, 566 aa, Artificial Sequence; identical to SEQ ID NO: 8277
  hemagglutinin__InfluenzaA__AFD64392

SEQ ID NO: 8324 - protein, 566 aa, Artificial Sequence; identical to SEQ ID NO: 8267
  hemagglutinin__InfluenzaA__AFD64403

SEQ ID NO: 8325 - protein, 566 aa, Artificial Sequence; identical to SEQ ID NO: 8267
  hemagglutinin__InfluenzaA__AFD64414

SEQ ID NO: 8326 - protein, 566 aa, Artificial Sequence
  hemagglutinin__InfluenzaA__AFD64425
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPNYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 8327 - protein, 566 aa, Artificial Sequence; identical to SEQ ID NO: 73
  hemagglutinin__InfluenzaA__AFD64436

SEQ ID NO: 8328 - protein, 566 aa, Artificial Sequence; identical to SEQ ID NO: 73
  hemagglutinin__InfluenzaA__AFD64447

SEQ ID NO: 8329 - protein, 566 aa, Artificial Sequence
  hemagglutinin__InfluenzaA__AFD64458
MKTIIALSYILCLVFAQKLPGNDNSTATLCLGHHAVQNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8330 - protein, 566 aa, Artificial Sequence; identical to SEQ ID NO: 6855
  hemagglutinin__InfluenzaA__AFD64795

SEQ ID NO: 8331 - protein, 566 aa, Artificial Sequence; identical to SEQ ID NO: 6982
  hemagglutinin__InfluenzaA__AFD64799

SEQ ID NO: 8332 - protein, 566 aa, Artificial Sequence
  hemagglutinin__InfluenzaA__AFD64802
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSEYKDWILWISFAISCFLLCVALLGFIMWACQKGNIRCNICI

SEQ ID NO: 8333 - protein, 566 aa, Artificial Sequence
  hemagglutinin__InfluenzaA__AFD64804
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8334 - protein, 566 aa, Artificial Sequence
  hemagglutinin__InfluenzaA__AFD64806
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8335 - protein, 566 aa, Artificial Sequence
  hemagglutinin__InfluenzaA__AFD64807
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQASGRITVSTKRSQQAVIPNIGSRPRVRDIPSRVSIYWTIVKPGDILLINSTGNLIAPRGYFKIRSGKSSIMRSDAPLGKCHSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDMYRDEALNNRFQIKGVELKSGYKDWILWISFAISCFLLCVALLGFIMWACQKGNIRCNICI

SEQ ID NO: 8336 - protein, 566 aa, Artificial Sequence
  hemagglutinin__InfluenzaA__AFD64810
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDPDVYRDEALNNRFQIKGVELKSGYKDWILWISFAISCFLLCVALLGFIMWACQKGNIRCNICI

SEQ ID NO: 8337 - protein, 566 aa, Artificial Sequence
  hemagglutinin__InfluenzaA__AFD64812
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAATDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8338 - protein, 566 aa, Artificial Sequence
  hemagglutinin__InfluenzaA__AFD64814
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDPDVYRDEALNNRFQIKGVELKSGYKDWILWISFAISCFLLCVALLGFIMWACQKGNIRCNICI

SEQ ID NO: 8339 - protein, 566 aa, Artificial Sequence
  hemagglutinin__InfluenzaA__AFD64816
MKTIIALSYILCLVFAQKLPENDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACMRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8340 - protein, 566 aa, Artificial Sequence
  hemagglutinin__InfluenzaA__AFD64818
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQASGRITVSTKRSQQAVIPNIGSRPRVRNIPSRVSIYWTIVKPGDILLINSTGNLIAPRGYFKIRSGKSSIMRSDAPLGKCISACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8341 - protein, 566 aa, Artificial Sequence
  hemagglutinin__InfluenzaA__AFD64819
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQASGRITVSTKRSQQAVIPNIGSRPRIRNIPSRVSIYWTIVKPGDILLINSTGNLIAPRGYFKIRSGKSSIMRSDAPIGKCISACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDPDVYRDEALNNRFQIKGVELKSGYKDWILWISFAISCFLLCVALLGFIMWACQKGNIRCNICI

SEQ ID NO: 8342 - protein, 566 aa, Artificial Sequence; identical to SEQ ID NO: 6982
  hemagglutinin__InfluenzaA__AFD64820

SEQ ID NO: 8343 - protein, 566 aa, Artificial Sequence
  hemagglutinin__InfluenzaA__AFD64822
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACMRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8344 - protein, 566 aa, Artificial Sequence
  hemagglutinin__InfluenzaA__AFD64823
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGRCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8345 - protein, 566 aa, Artificial Sequence
  hemagglutinin__InfluenzaA__AFD64824
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFATSCFLLCVALLGFIMWACQKGNIRCNICI

SEQ ID NO: 8346 - protein, 566 aa, Artificial Sequence; identical to SEQ ID NO: 8334
  hemagglutinin__InfluenzaA__AFD64825

SEQ ID NO: 8347 - protein, 566 aa, Artificial Sequence; identical to SEQ ID NO: 8334
  hemagglutinin__InfluenzaA__AFD64827

SEQ ID NO: 8348 - protein, 566 aa, Artificial Sequence
  hemagglutinin__InfluenzaA__AFD64828
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDPDVYRDEALNNRFQIKGVELKSGYKDWILWISFAISCFLLCVALLGFIMWACQKGNIRCNICI

SEQ ID NO: 8349 - protein, 566 aa, Artificial Sequence; identical to SEQ ID NO: 8343
  hemagglutinin__InfluenzaA__AFD64830

SEQ ID NO: 8350 - protein, 566 aa, Artificial Sequence; identical to SEQ ID NO: 6982
  hemagglutinin__InfluenzaA__AFD98095

SEQ ID NO: 8351 - protein, 566 aa, Artificial Sequence
  hemagglutinin__InfluenzaA__AFD98106
MKTIIALSYILCLVFAQKLPGNDNSTATLCLGHHAVPNGTIVKTITNDQIEVTNATELVQSSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8352 - protein, 566 aa, Artificial Sequence
  hemagglutinin__InfluenzaA__AFD98128
MKTIIALSYILCLVFAQKLPGNDNSTATLCLGHHAVPNGTIVKTITNDQIEVTNATELVQNSSTGEICNSPHQILDGENCTLIDALLGDPQCDGFQNKKWDLFVERSKAHSNCYPYDVPDYASLRSLVASSGTLEFNNESFNWTGVTQNGTSSACIRKSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8353 - protein, 566 aa, Artificial Sequence; identical to SEQ ID NO: 6982
  hemagglutinin__InfluenzaA__AFD98139

SEQ ID NO: 8354 - protein, 566 aa, Artificial Sequence
  hemagglutinin__InfluenzaA__AFD98161
MKTIIALSYILCLVFAQKLPGNDNSTATLCLGHHAVPNGTIVKTITNDQIEVTNATELVQNSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8355 - protein, 566 aa, Artificial Sequence
  hemagglutinin__InfluenzaA__AFD98172
MKTIIALSYILCLVFAQKLPGNDNSTATLCLGHHAVPNGTIVKTITNDQIEVTNATELVQSSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWVLWISFAISCFLLCVALLGFIMWACQKGNIRCNICI

SEQ ID NO: 8356 - protein, 566 aa, Artificial Sequence
  hemagglutinin__InfluenzaA__AFD98183
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVLPNIGSRPRVRNIPSRVSIYWTIVKPGDILLINSTGNLIAPRGYFKIRSGKSSIMRSDAPIGKCNSTCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8357 - protein, 566 aa, Artificial Sequence; identical to SEQ ID NO: 6855
  hemagglutinin__InfluenzaA__AFD98194

SEQ ID NO: 8358 - protein, 566 aa, Artificial Sequence; identical to SEQ ID NO: 6909
  hemagglutinin__InfluenzaA__AFD98205

SEQ ID NO: 8359 - protein, 566 aa, Artificial Sequence; identical to SEQ ID NO: 8351
  hemagglutinin__InfluenzaA__AFD98215

SEQ ID NO: 8360 - protein, 566 aa, Artificial Sequence; identical to SEQ ID NO: 6982
  hemagglutinin__InfluenzaA__AFD98226

SEQ ID NO: 8361 - protein, 566 aa, Artificial Sequence
  hemagglutinin__InfluenzaA__AFD98237
MKTIIALSYILCLVSAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8362 - protein, 566 aa, Artificial Sequence; identical to SEQ ID NO: 8354
  hemagglutinin__InfluenzaA__AFD98248

SEQ ID NO: 8363 - protein, 566 aa, Artificial Sequence
  hemagglutinin__InfluenzaA__AFD98259
MKTIIALSYILCLVFAQKLPGNDNSTATLCLGHHAVPNGTIVKTITNDQIEVTNATELVQSSSAGEICDSPHHILDGENCTLIDALLGDPQCDGFQNKKWDLFVERSKAYSNCYPYDVQDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8364 - protein, 566 aa, Artificial Sequence
  hemagglutinin__InfluenzaA__AFD98270
MKAILVVLLYTFVTANADTLCIGYHANNSTDTVDTVLEKNVTVTHSVNLLEDKHNGKLCKLRGVTPLHLGKCNIAGWILGNPECESLSTASSWSYIVETSSSDNGTCYPGDFINYEELREQLSSVSSFERFEIFPNTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8365 - protein, 566 aa, Artificial Sequence
  hemagglutinin__InfluenzaA__AFD98280
MKAILVVLLYTFATANADTLCIGYHANNSTDTVDTVLEKNVTVTHSVNLLEDKHNGKLCKLRGVAPLHLGKCNIAGWILGNPECDSLSTARSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8366 - protein, 566 aa, Artificial Sequence; identical to SEQ ID NO: 8343
  hemagglutinin__InfluenzaA__AFD98290

SEQ ID NO: 8367 - protein, 566 aa, Artificial Sequence; identical to SEQ ID NO: 7086
  hemagglutinin__InfluenzaA__AFD98310

SEQ ID NO: 8368 - protein, 566 aa, Artificial Sequence; identical to SEQ ID NO: 6454
  hemagglutinin__InfluenzaA__AFD98320

SEQ ID NO: 8369 - protein, 566 aa, Artificial Sequence; identical to SEQ ID NO: 8354
  hemagglutinin__InfluenzaA__AFD98340

SEQ ID NO: 8370 - protein, 566 aa, Artificial Sequence
  hemagglutinin__InfluenzaA__AFD98351
MKTIIALSYILCLVFAQKLPGNDNSTATLCLGHHAVPNGTIVKTITNDQIEVTNATELVQSSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGTIRNGTYDHDVYRDEALNNRFQIKGVELKSGYKDWILWISFAISCFLLCVALLGFIMWACQKGNIRCNICI

SEQ ID NO: 8371 - protein, 566 aa, Artificial Sequence
  hemagglutinin__InfluenzaA__AFD98362
MKTIIALSYILCLVFAQKLPGNDNSMATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRGQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLVGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8372 - protein, 566 aa, Artificial Sequence; identical to SEQ ID NO: 8351
  hemagglutinin__InfluenzaA__AFD98373

SEQ ID NO: 8373 - protein, 566 aa, Artificial Sequence; identical to SEQ ID NO: 6982
  hemagglutinin__InfluenzaA__AFD98384

SEQ ID NO: 8374 - protein, 566 aa, Artificial Sequence
  hemagglutinin__InfluenzaA__AFD98395
MKTIIALSYILCLVFAQKLPGDDNSTATLCLGHHAVPNGTIVKTITNDQIEVTNATELVQNSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8375 - protein, 566 aa, Artificial Sequence; identical to SEQ ID NO: 8351
  hemagglutinin__InfluenzaA__AFD98406

SEQ ID NO: 8376 - protein, 566 aa, Artificial Sequence; identical to SEQ ID NO: 8354
  hemagglutinin__InfluenzaA__AFD98417

SEQ ID NO: 8377 - protein, 566 aa, Artificial Sequence
  hemagglutinin__InfluenzaA__AFD98428
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFTISCFLLCVALLGFIMWACQKGNIRCNICI

SEQ ID NO: 8378 - protein, 566 aa, Artificial Sequence; identical to SEQ ID NO: 6867
  hemagglutinin__InfluenzaA__AFD98439

SEQ ID NO: 8379 - protein, 566 aa, Artificial Sequence
  hemagglutinin__InfluenzaA__AFD98449
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNENFNWTGVTQNGTSSACIRRSKNSFFSRLNWLTHLNFKFPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 8380 - protein, 566 aa, Artificial Sequence
  hemagglutinin__InfluenzaA__AFD98460
MKTIIALSYILCLVFAQKLPGNDNSTATLCLGHHAVPNGTIVKTITNDQIEVTNATELVQSSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSKLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALSNRFQIKGVELKSGYKDWILWISFAISCFLLCVALLGFIMWACQKGNIRCNICI

SEQ ID NO: 8381 - protein, 566 aa, Artificial Sequence; identical to SEQ ID NO: 6867
  hemagglutinin__InfluenzaA__AFD98471

SEQ ID NO: 8382 - protein, 566 aa, Artificial Sequence
  hemagglutinin__InfluenzaA__AFD98481
MKTIIALSYILCLVFAQKLPGNDNSTATLCLGHHAVPNGTIVKTITNDQIEVTNATELVQNSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSVMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8383 - protein, 566 aa, Artificial Sequence; identical to SEQ ID NO: 6982
  hemagglutinin__InfluenzaA__AFD98492

SEQ ID NO: 8384 - protein, 566 aa, Artificial Sequence
  hemagglutinin__InfluenzaA__AFD98503
MKTIIALSYILCLVFAQKLPGNDNSTATLCLGHHAVPNGTIVKTITNDQIEVTNATELVQSSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTKGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8385 - protein, 566 aa, Artificial Sequence; identical to SEQ ID NO: 6982
  hemagglutinin__InfluenzaA__AFD98514

SEQ ID NO: 8386 - protein, 566 aa, Artificial Sequence; identical to SEQ ID NO: 8334
  hemagglutinin__InfluenzaA__AFD98525

SEQ ID NO: 8387 - protein, 566 aa, Artificial Sequence; identical to SEQ ID NO: 6855
  hemagglutinin__InfluenzaA__AFD98558

SEQ ID NO: 8388 - protein, 566 aa, Artificial Sequence
  hemagglutinin__InfluenzaA__AFD98569
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHECDNACIGSIRNGTYDHDVYRDEALNNRFQIKGVELKSGYKDWILWISFAISCFLLCVALLGFIMWACQKGNIRCNICI

SEQ ID NO: 8389 - protein, 566 aa, Artificial Sequence; identical to SEQ ID NO: 6855
  hemagglutinin__InfluenzaA__AFD98580

SEQ ID NO: 8390 - protein, 566 aa, Artificial Sequence
  hemagglutinin__InfluenzaA__AFE02942
MKAILVVLLYTFATANADTLCIGYHANNSTDTVDTLLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVWTSRYSKKFKPEIAIRPKVRDQEGRMNYYWTLVEPGDKITFEATGNLVVPRYAFAMDRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8391 - protein, 566 aa, Artificial Sequence; identical to SEQ ID NO: 3833
  hemagglutinin__InfluenzaA__AFE18688

SEQ ID NO: 8392 - protein, 566 aa, Artificial Sequence; identical to SEQ ID NO: 650
  hemagglutinin__InfluenzaA__AFE47624

SEQ ID NO: 8393 - protein, 566 aa, Artificial Sequence; identical to SEQ ID NO: 1400
  hemagglutinin__InfluenzaA__AFE47635

SEQ ID NO: 8394 - protein, 566 aa, Artificial Sequence; identical to SEQ ID NO: 6982
  hemagglutinin__InfluenzaA__AFF18506

SEQ ID NO: 8395 - protein, 566 aa, Artificial Sequence
  hemagglutinin__InfluenzaA__AFF57124
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKENSYPKLSKSYINDKGKEVLVLWGIHHPSTTADQQRLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8396 - protein, 566 aa, Artificial Sequence
  hemagglutinin__InfluenzaA__AFF57128
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSIYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8397 - protein, 566 aa, Artificial Sequence
  hemagglutinin__InfluenzaA__AFF57132
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSIYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNETYDYPKYSEEAKLNREEIDGVKLESTRIYQILAIYSTVASSLVLVVSLGAISFWMCSNGSLQCRICI

SEQ ID NO: 8398 - protein, 566 aa, Artificial Sequence
  hemagglutinin__InfluenzaA__AFF57136
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVYDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8399 - protein, 566 aa, Artificial Sequence
  hemagglutinin__InfluenzaA__AFF57144
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSDDQQSLYQNEDAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8400 - protein, 566 aa, Artificial Sequence
  hemagglutinin__InfluenzaA__AFF57148
MKAILVVLLYTFATANADTLCIGYHANNSTDTVDTLLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSDDQQSLYQNEDAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8401 - protein, 566 aa, Artificial Sequence
  hemagglutinin__InfluenzaA__AFF57160
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSESYINDKGKEVLVLWGIHHPSTSADQQSLYQNEDAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8402 - protein, 566 aa, Artificial Sequence
  hemagglutinin__InfluenzaA__AFF57164
MKAILVVLLYTFATANADTLCIGYHANNSTDTVDTVLEKNVTVTHSVNLLEDKHNEKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8403 - protein, 566 aa, Artificial Sequence; identical to SEQ ID NO: 8402
  hemagglutinin__InfluenzaA__AFF57168

SEQ ID NO: 8404 - protein, 566 aa, Artificial Sequence
  hemagglutinin__InfluenzaA__AFF57172
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNEDAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8405 - protein, 566 aa, Artificial Sequence
  hemagglutinin__InfluenzaA__AFF57176
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKENSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8406 - protein, 566 aa, Artificial Sequence
  hemagglutinin__InfluenzaA__AFF57184
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKENSYQKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8407 - protein, 566 aa, Artificial Sequence; identical to SEQ ID NO: 8399
  hemagglutinin__InfluenzaA__AFF57188

SEQ ID NO: 8408 - protein, 568 aa, Artificial Sequence
  hemagglutinin__InfluenzaA__AFF60787
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSEVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 8409 - protein, 566 aa, Artificial Sequence
  hemagglutinin__InfluenzaA__AFG29042
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETFSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8410 - protein, 566 aa, Artificial Sequence
  hemagglutinin__InfluenzaA__AFG29044
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSTDQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8411 - protein, 566 aa, Artificial Sequence; identical to SEQ ID NO: 2669
  hemagglutinin__InfluenzaA__AFG31060

SEQ ID NO: 8412 - protein, 566 aa, Artificial Sequence; identical to SEQ ID NO: 5224
  hemagglutinin__InfluenzaA__AFG31070

SEQ ID NO: 8413 - protein, 566 aa, Artificial Sequence; identical to SEQ ID NO: 2656
  hemagglutinin__InfluenzaA__AFG31080

SEQ ID NO: 8414 - protein, 566 aa, Artificial Sequence
  hemagglutinin__InfluenzaA__AFG31100
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDLNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLIVSLGAISFWMCSNGSLQCRICI

SEQ ID NO: 8415 - protein, 566 aa, Artificial Sequence; identical to SEQ ID NO: 2669
  hemagglutinin__InfluenzaA__AFG31110

SEQ ID NO: 8416 - protein, 566 aa, Artificial Sequence; identical to SEQ ID NO: 2911
  hemagglutinin__InfluenzaA__AFG31120

SEQ ID NO: 8417 - protein, 566 aa, Artificial Sequence; identical to SEQ ID NO: 2911
  hemagglutinin__InfluenzaA__AFG31130

SEQ ID NO: 8418 - protein, 566 aa, Artificial Sequence; identical to SEQ ID NO: 2911
  hemagglutinin__InfluenzaA__AFG31140

SEQ ID NO: 8419 - protein, 566 aa, Artificial Sequence; identical to SEQ ID NO: 3771
  hemagglutinin__InfluenzaA__AFG31150

SEQ ID NO: 8420 - protein, 566 aa, Artificial Sequence; identical to SEQ ID NO: 3771
  hemagglutinin__InfluenzaA__AFG31160

SEQ ID NO: 8421 - protein, 566 aa, Artificial Sequence; identical to SEQ ID NO: 2669
  hemagglutinin__InfluenzaA__AFG31170

SEQ ID NO: 8422 - protein, 566 aa, Artificial Sequence; identical to SEQ ID NO: 2669
  hemagglutinin__InfluenzaA__AFG31180

SEQ ID NO: 8423 - protein, 566 aa, Artificial Sequence; identical to SEQ ID NO: 2669
  hemagglutinin__InfluenzaA__AFG31190

SEQ ID NO: 8424 - protein, 566 aa, Artificial Sequence; identical to SEQ ID NO: 2669
  hemagglutinin__InfluenzaA__AFG31200

SEQ ID NO: 8425 - protein, 566 aa, Artificial Sequence; identical to SEQ ID NO: 2669
  hemagglutinin__InfluenzaA__AFG31210

SEQ ID NO: 8426 - protein, 566 aa, Artificial Sequence; identical to SEQ ID NO: 2669
  hemagglutinin__InfluenzaA__AFG31220

SEQ ID NO: 8427 - protein, 566 aa, Artificial Sequence; identical to SEQ ID NO: 5224
  hemagglutinin__InfluenzaA__AFG31230

SEQ ID NO: 8428 - protein, 566 aa, Artificial Sequence; identical to SEQ ID NO: 2669
  hemagglutinin__InfluenzaA__AFG31240

SEQ ID NO: 8429 - protein, 566 aa, Artificial Sequence; identical to SEQ ID NO: 2669
  hemagglutinin__InfluenzaA__AFG31250

SEQ ID NO: 8430 - protein, 566 aa, Artificial Sequence; identical to SEQ ID NO: 2669
  hemagglutinin__InfluenzaA__AFG31260

SEQ ID NO: 8431 - protein, 566 aa, Artificial Sequence; identical to SEQ ID NO: 2669
  hemagglutinin__InfluenzaA__AFG31270

SEQ ID NO: 8432 - protein, 566 aa, Artificial Sequence; identical to SEQ ID NO: 2669
  hemagglutinin__InfluenzaA__AFG31280

SEQ ID NO: 8433 - protein, 566 aa, Artificial Sequence; identical to SEQ ID NO: 2669
  hemagglutinin__InfluenzaA__AFG31290

SEQ ID NO: 8434 - protein, 566 aa, Artificial Sequence
  hemagglutinin__InfluenzaA__AFG31300
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNINPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8435 - protein, 566 aa, Artificial Sequence; identical to SEQ ID NO: 5224
  hemagglutinin__InfluenzaA__AFG31310

SEQ ID NO: 8436 - protein, 566 aa, Artificial Sequence; identical to SEQ ID NO: 2669
  hemagglutinin__InfluenzaA__AFG31323

SEQ ID NO: 8437 - protein, 566 aa, Artificial Sequence; identical to SEQ ID NO: 2669
  hemagglutinin__InfluenzaA__AFG31333

SEQ ID NO: 8438 - protein, 566 aa, Artificial Sequence; identical to SEQ ID NO: 2669
  hemagglutinin__InfluenzaA__AFG31343

SEQ ID NO: 8439 - protein, 566 aa, Artificial Sequence; identical to SEQ ID NO: 2669
  hemagglutinin__InfluenzaA__AFG31353

SEQ ID NO: 8440 - protein, 566 aa, Artificial Sequence; identical to SEQ ID NO: 2669
  hemagglutinin__InfluenzaA__AFG31363

SEQ ID NO: 8441 - protein, 566 aa, Artificial Sequence; identical to SEQ ID NO: 2669
  hemagglutinin__InfluenzaA__AFG31376

SEQ ID NO: 8442 - protein, 566 aa, Artificial Sequence; identical to SEQ ID NO: 2669
  hemagglutinin__InfluenzaA__AFG31386

SEQ ID NO: 8443 - protein, 566 aa, Artificial Sequence; identical to SEQ ID NO: 2669
  hemagglutinin__InfluenzaA__AFG31396

SEQ ID NO: 8444 - protein, 566 aa, Artificial Sequence; identical to SEQ ID NO: 2669
  hemagglutinin__InfluenzaA__AFG31406

SEQ ID NO: 8445 - protein, 566 aa, Artificial Sequence; identical to SEQ ID NO: 2669
  hemagglutinin__InfluenzaA__AFG31416

SEQ ID NO: 8446 - protein, 566 aa, Artificial Sequence; identical to SEQ ID NO: 2669
  hemagglutinin__InfluenzaA__AFG31426

SEQ ID NO: 8447 - protein, 566 aa, Artificial Sequence; identical to SEQ ID NO: 2669
  hemagglutinin__InfluenzaA__AFG31436

SEQ ID NO: 8448 - protein, 566 aa, Artificial Sequence; identical to SEQ ID NO: 2669
  hemagglutinin__InfluenzaA__AFG31446

SEQ ID NO: 8449 - protein, 566 aa, Artificial Sequence; identical to SEQ ID NO: 2669
  hemagglutinin__InfluenzaA__AFG31456

SEQ ID NO: 8450 - protein, 566 aa, Artificial Sequence; identical to SEQ ID NO: 2669
  hemagglutinin__InfluenzaA__AFG31466

SEQ ID NO: 8451 - protein, 566 aa, Artificial Sequence; identical to SEQ ID NO: 3771
  hemagglutinin__InfluenzaA__AFG31486

SEQ ID NO: 8452 - protein, 566 aa, Artificial Sequence; identical to SEQ ID NO: 2669
  hemagglutinin__InfluenzaA__AFG31496

SEQ ID NO: 8453 - protein, 566 aa, Artificial Sequence; identical to SEQ ID NO: 2669
  hemagglutinin__InfluenzaA__AFG31506

SEQ ID NO: 8454 - protein, 566 aa, Artificial Sequence; identical to SEQ ID NO: 2669
  hemagglutinin__InfluenzaA__AFG31516

SEQ ID NO: 8455 - protein, 566 aa, Artificial Sequence; identical to SEQ ID NO: 2760
  hemagglutinin__InfluenzaA__AFG31526

SEQ ID NO: 8456 - protein, 566 aa, Artificial Sequence; identical to SEQ ID NO: 2669
  hemagglutinin__InfluenzaA__AFG31536

SEQ ID NO: 8457 - protein, 566 aa, Artificial Sequence; identical to SEQ ID NO: 5224
  hemagglutinin__InfluenzaA__AFG31546

SEQ ID NO: 8458 - protein, 566 aa, Artificial Sequence; identical to SEQ ID NO: 5224
  hemagglutinin__InfluenzaA__AFG31556

SEQ ID NO: 8459 - protein, 566 aa, Artificial Sequence; identical to SEQ ID NO: 2669
  hemagglutinin__InfluenzaA__AFG31566

SEQ ID NO: 8460 - protein, 566 aa, Artificial Sequence; identical to SEQ ID NO: 2911
  hemagglutinin__InfluenzaA__AFG31586

SEQ ID NO: 8461 - protein, 566 aa, Artificial Sequence; identical to SEQ ID NO: 2911
  hemagglutinin__InfluenzaA__AFG31596

SEQ ID NO: 8462 - protein, 566 aa, Artificial Sequence; identical to SEQ ID NO: 2911
  hemagglutinin__InfluenzaA__AFG31606

SEQ ID NO: 8463 - protein, 566 aa, Artificial Sequence; identical to SEQ ID NO: 2911
  hemagglutinin__InfluenzaA__AFG31616

SEQ ID NO: 8464 - protein, 566 aa, Artificial Sequence; identical to SEQ ID NO: 2911
  hemagglutinin__InfluenzaA__AFG31626

SEQ ID NO: 8465 - protein, 566 aa, Artificial Sequence; identical to SEQ ID NO: 2669
  hemagglutinin__InfluenzaA__AFG31636

SEQ ID NO: 8466 - protein, 566 aa, Artificial Sequence; identical to SEQ ID NO: 2669
  hemagglutinin__InfluenzaA__AFG31646

SEQ ID NO: 8467 - protein, 566 aa, Artificial Sequence; identical to SEQ ID NO: 3833
  hemagglutinin__InfluenzaA__AFG31656

SEQ ID NO: 8468 - protein, 566 aa, Artificial Sequence; identical to SEQ ID NO: 3833
  hemagglutinin__InfluenzaA__AFG31666

SEQ ID NO: 8469 - protein, 566 aa, Artificial Sequence
  hemagglutinin__InfluenzaA__AFG71865
MKTIIALSYIFCLALGQDLPGNDNSTATLCLGHHAVPNGTLVKTITNDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGIGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 8470 - protein, 566 aa, Artificial Sequence; identical to SEQ ID NO: 1556
  hemagglutinin__InfluenzaA__AFG71876

SEQ ID NO: 8471 - protein, 566 aa, Artificial Sequence
  hemagglutinin__InfluenzaA__AFG71898
MKTIIALSYLFCLAFGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFTTEGFTWTGVTQNGGSNACKRGPGSGFFSRLNWLTKSGSTYPVLNVTMSNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCVSECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 8472 - protein, 566 aa, Artificial Sequence
  hemagglutinin__InfluenzaA__AFG71920
MKTIIALSYIFCLALGQDLPGNDNSTATLCLGHHAVPNGTLVKTITNDQIEVTNATELVQSSSTGKICNNPHRILDGINCTLIDALLGDPHCDVFQDETWDLFVERSKAFSNCYPYDVPDYASLRSLIASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 8473 - protein, 566 aa, Artificial Sequence
  hemagglutinin__InfluenzaA__AFG71931
MKTIIALSYIFCLVIGQDLPGNENSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFITEGFTWTGVTQNGGSNACKRGPGIGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 8474 - protein, 566 aa, Artificial Sequence
  hemagglutinin__InfluenzaA__AFG71942
MKTIIALSYIFYLALSQDLPGNDNSKATLCLGHHAVPNGTLVKTITDDQTEVTNATELVQSSSTGKICNNPHRILDGMDCTLIDALLGDPHCDVFQNETWDLFVERSKAFSNCYPYDVPDYASLRSLVASSGTLEFITEGFTWTEVTQNGGSIACKRGPDSGFFSRLNWLTKSGRTYPVLNVTMPNNDNFDKLYIWGVHHPSTDQEQTNLYVQTSGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRIIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 8475 - protein, 566 aa, Artificial Sequence
  hemagglutinin__InfluenzaA__AFG71953
MKTIIALSYIFCLVLGQDLPGNDKSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTKRSQQTIIPNIGSRPWVRGPSSRISIYWTTVKPGDILIINSNGNLIAPRGYFKMRTGKSSIMRSDAPIGACISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGVIMWACQKGNIRCNICI

SEQ ID NO: 8476 - protein, 566 aa, Artificial Sequence; identical to SEQ ID NO: 305
  hemagglutinin__InfluenzaA__AFG71975

SEQ ID NO: 8477 - protein, 566 aa, Artificial Sequence
  hemagglutinin__InfluenzaA__AFG71996
MKTIIALSYIFCLVLGQNFPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGPDIGFFSRLNWLYKSGNTYPVLNVSMPNNDNFDKLYIWGVHHPSTDQEQTSLYVQASGRVTVSTKRSQQTIIPNIGSRPWVRGLSSRISIYWTIVKPGDILVINSNGNLIAPRGYFKMRTGKSSIMRSDASIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRIIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8478 - protein, 566 aa, Artificial Sequence
  hemagglutinin__InfluenzaA__AFG72007
MKTIIALSYIFCLVLGRDFPRNDNSTATLCLGHHAVPNGTLVKTITNDQIEVTNATELVQSSSTGKICNNPHRILDGMDCTLIDALLGDPHCDGLQNGTWDLFVERSKAFSNCYPYDVPDYASLRSLVASSGTLEFINEGFTWTGVTQNGGSNACKRGPDSGFFSRLNWLYKSGNTYPVLNVTMPNNDNFDKLYIWGVHHPSTDQDQTSLYVQASGRVTVSTKRSQQTVIPNIGPRPWVRGLSSRISIYWTIVKPGDILLINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHRCDNACIGSIRNGTYDHDVYRDEALNNRFQIKGVELKSGYKDWILWISFAISCFLLCVVLLGFIMWACQKGNIRCNICI

SEQ ID NO: 8479 - protein, 566 aa, Artificial Sequence
  hemagglutinin__InfluenzaA__AFG72029
MKTIIALSYIFCLVFGQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLIASSGTLEFINEGFNWTGVTQSGGSYACKRGSDNSFFSRLNWLYESESKYPVLNVTMPNNGNFDKLYIWGVHHPSTDKEQTNLYVRASGRVTVSTKRSQQTIIPNIGSRPWVRGLSSRISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8480 - protein, 566 aa, Artificial Sequence
  hemagglutinin__InfluenzaA__AFG72040
MKTIIALSYIFCLVFAQNLPGNDNSTATLCLGHHAVPNGTLVKTITNDQIEVTNATELVQSSSTGRICDSPHRILDGKNCTLVDALLGDPHCDGFQNEKWDLFVERSKAFSNCYPYDVPDYASLRSLVASSGTLEFINESFNWTGVTQSGGSYACKRGSDNSFFSRLNWLYESESKYPVLNVTMPNNGNFDKLYIWGVHHPSTDKEQTNLYVRASGRVTVSTKRSQQTIIPNIGSRPWVRGLSSRISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVENTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8481 - protein, 566 aa, Artificial Sequence
  hemagglutinin__InfluenzaA__AFG72051
MKTIIALSYIFCLVFAQNLPGNDNSTATLCLGHHAVPNGTLVKTITNDQIEVTNATELVQSSSTGRICDSPHRILDGKNCTLVDALLGDPHCDGFQNEKWDLFVERSKAFSNCYPYDVPDYASLRSLVASSGTLEFINESFNWTGVTQSGGSYACKRGSDNSFFSRLNWLYESESKYPVLNVTMPNNGNFDKLYIWGVHHPSTDKEQTNLYVRASGRVTVSTKRNQQTVIPNIGSRPWVRGLSSRISIYWTIVKPGDILLINSNGNLIAPRGYFKIHNGKSSIMRSDAPIGTCSSECITPNGSIPNDKPFQNVNKITYGACPKYVKQNTLKLATGMRNVPEKQTRGIFGAIAGFIENGWEGMVDGWYGFRHRNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8482 - protein, 566 aa, Artificial Sequence
  hemagglutinin__InfluenzaA__AFG72085
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWIGVTQSGGSCACKRGSVNSFFSRLNWLHESEQKYPALNVTMPNNGKFDKLYIWGVHHPSTDREQTNLYVRASGRVTVSTKRSQQTVIPNIGSRPWVRGLSSRISIYWTIVKPGDILLINSIGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8483 - protein, 566 aa, Artificial Sequence
  hemagglutinin__InfluenzaA__AFG72107
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLIASSGTLEFINEEFNWTGVTQNGGSYACKRGSVNSFFSRLNWLHESEYKYPALNVTMPNNGRFDKLYIWGVHHPSTDREQTNLYVRASGRVTVSTKRSQQTVIPNIGPRPWVRGLSSRISIYWTIVKPGDILLINSTGNLIAPRGYFKIHTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEAVNNRFQIKGVELKSGYKDWILWISFAISCFLLCVILLGFIMWACQKGNIRCNICI

SEQ ID NO: 8484 - protein, 566 aa, Artificial Sequence
  hemagglutinin__InfluenzaA__AFG72118
MKTIIALSYIFCLVFAQKLPGNDNSTATLCLGHHAVPNGTLVKTITNDQIEVTNATELVQNSSTGRICNSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPERQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 8485 - protein, 566 aa, Artificial Sequence
  hemagglutinin__InfluenzaA__AFG72129
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSGISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8486 - protein, 566 aa, Artificial Sequence
  hemagglutinin__InfluenzaA__AFG72140
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPSTDREQTNLYVRALGRVTVSTKRSQQTVIPNIGSRPWVRGLSSRISIYWTIVKPGDILLINSTGNLIAPRGYFKIRTGKSSIMRSDAPIGTCSSECITPNGSIPNNKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8487 - protein, 566 aa, Artificial Sequence
  hemagglutinin__InfluenzaA__AFG72151
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEDFNWTGVAQSGESYACKRGSVKSFFSRLNWLHESDYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8488 - protein, 566 aa, Artificial Sequence
  hemagglutinin__InfluenzaA__AFG72184
MKTIIALSYILCLVFAQKLPGNDNSTATLCLGHHAVPNGTLVKTITNDQIEVTNATELVQSSSTGRICDSPHRILDGKNCTLIDALLGDPHCDDFQNKEWDLFVERSKAYSNCYPYDVPDYASLRSLVASSGTLEFINEDFNWTGVAQSGESYACKRGSVKSFFSRLNWLHESEYKYPALNVTMPNNDKFDKLYIWGVHHPSTEREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8489 - protein, 566 aa, Artificial Sequence; identical to SEQ ID NO: 8487
  hemagglutinin__InfluenzaA__AFG72195

SEQ ID NO: 8490 - protein, 566 aa, Artificial Sequence
  hemagglutinin__InfluenzaA__AFG72206
MKTIIALSYILCLVFAQKLPGNDNSTATLCLGHHAVPNGTLVKTITNDQIEVTNATELVQSSSTGKICDSPHRILDGKNCTLIDALLGDPHCDGFQNKEWDLFVERSKAYSNCYPYDVPDYASLRSLVASSGTLEFINEDFNWTGVAQSGESYACKRGSVKSFFSRLNWLHESDYKYPALNVTMPNNGKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8491 - protein, 566 aa, Artificial Sequence
  hemagglutinin__InfluenzaA__AFG72217
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGLSSRISIYWTIVKPGDILLISSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADIKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDLILWISFAISCFLLCVVLLGFIMWACQKGNIRCNICI

SEQ ID NO: 8492 - protein, 566 aa, Artificial Sequence
  hemagglutinin__InfluenzaA__AFG72228
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEDFNWTGVAQSGESYACKRGSVKSFFSRLNWLHESDYKYPELNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8493 - protein, 566 aa, Artificial Sequence
  hemagglutinin__InfluenzaA__AFG72239
MKTIIALSYILCLVLAQKLPGSDNSTATLCLGHHAVPNGTLVKTITNDQIEVTNATELVQSSTTGRICDSPHRILDGKNCTLIDALLGDPHCDGFQNKEWDLFVERSKAYSNCYPYDVPDYASLRSLVASSGTLEFTNEDFNWTGVAQSGESYACKRGSVKSFFSRLNWLHESDYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8494 - protein, 566 aa, Artificial Sequence; identical to SEQ ID NO: 8487
  hemagglutinin__InfluenzaA__AFG72272

SEQ ID NO: 8495 - protein, 566 aa, Artificial Sequence
  hemagglutinin__InfluenzaA__AFG72316
MKTIIALSHILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGLSSRISIYWTIVKPGDILLINSTGNLIAPRGYFKIRNGKSSIMRSDVPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8496 - protein, 566 aa, Artificial Sequence
  hemagglutinin__InfluenzaA__AFG72339
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYVSLRSLVASSGTLEFINEDFNWTGVAQDGGSYTCKRGSVNSFFSRLNWLHKSEYKYPALNVTMPNNGKFDKLYIWGVHHPSTDSDQTSLYVRASGRVTVSTKRSQQTVTPNIGSRPWVRGLSSRISIYWTIVKPGDILLINSTGNLIAPRGYFKIRNGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8497 - protein, 566 aa, Artificial Sequence
  hemagglutinin__InfluenzaA__AFG72350
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYVSLRSLVASSGTLEFINEDFNWTGVAQDGRSYACKRGSVNSFFSRLNWLHKSEYKYPALNVTMPNNGKFDKLYIWGVHHPSTDSDQTSLYVRASGRVTVSTKRSQQTVTPNIGSRPWVRGLSSRISIYWTIVKPGDILLINSTGNLIAPRGYFKIRNGKSSIMRSDAPIGICSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8498 - protein, 566 aa, Artificial Sequence
  hemagglutinin__InfluenzaA__AFG72372
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYTCKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8499 - protein, 566 aa, Artificial Sequence; identical to SEQ ID NO: 1024
  hemagglutinin__InfluenzaA__AFG72383

SEQ ID NO: 8500 - protein, 566 aa, Artificial Sequence
  hemagglutinin__InfluenzaA__AFG72394
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVATKRSQQTVIPNIGFRPWVRGQSSGISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8501 - protein, 566 aa, Artificial Sequence
  hemagglutinin__InfluenzaA__AFG72405
MKTIIALSYILCLVFAQKLPGNDNSTATLCLGHHAVPNGTLVKTITNDQIEVTNATELVQSSSTGRICDSPHRILDGKNCTLIDALLGDPNCDGFQNKEWDLFVERSKAYSNCYPYDVPDYASLRSLVASSGTLEFTNEDFNWTGVAQDGGSYACKRGSVKSFFSRLNWLHKLEYKYPALNVTMPNNGKFDKLYIWGVHHPSTDSDQTSLYVRASGRVTVSTKRSQQTVTPNIGSRPWVRGLSSRISIYWTIVKPGDILLINSTGNLIAPRGYFKIRNGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8502 - protein, 566 aa, Artificial Sequence
  hemagglutinin__InfluenzaA__AFG72449
MKTIIALSYILCLVFAQKLPGNDNSTATLCLGHHAVPNGTLVKTITNDQIEVTNATELVQSSSTGRICYSPHRILDGNNCTLIDALLGDPHCDGFQNKEWDLFVERSKAYSNCYPYDVPDYASLRSLVASSGTLEFINEDFNWTGVAQDGKSYACKRGSVKGFFSRLNWLHKLEYKYPALNVTMPNNGKFDKLYIWGVHHPSTDSDQTSLYVRASGGVTVSTKRSQQTVIPSIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8503 - protein, 566 aa, Artificial Sequence; identical to SEQ ID NO: 1053
  hemagglutinin__InfluenzaA__AFG72460

SEQ ID NO: 8504 - protein, 566 aa, Artificial Sequence
  hemagglutinin__InfluenzaA__AFG72504
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVKSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIIRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8505 - protein, 566 aa, Artificial Sequence
  hemagglutinin__InfluenzaA__AFG72515
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFINENFNWTGVAQDGKSYACKRGSVNSFFSRLNWLHKLEYKYPALNVTMPNNGKFDKLYIWGVHHPSTDSDQTSLYVRASGRVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8506 - protein, 566 aa, Artificial Sequence
  hemagglutinin__InfluenzaA__AFG72526
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSSCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVIVSTKRSQQTVIPNIGSRPWVRGLSSRISIYWTIVKPGDILLINSTGNLIAPRGYFKIRTGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQTAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8507 - protein, 566 aa, Artificial Sequence
  hemagglutinin__InfluenzaA__AFG72581
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGGVTVSTKRSQQTVIPNIGYRPWVRGLSSRISIYWTIVKPGDILLINSTGNLIAPRGYFKIRNGKSSIMRSDAPIGNCSSECITPNGSISNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8508 - protein, 566 aa, Artificial Sequence
  hemagglutinin__InfluenzaA__AFG72603
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTKEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIGNCKSECITPNGSIPNDKPFQNVNRITYGACPRYVKQNTLKLATGMRNVPEKQTRGIFGAIAGFIENGWEGMVDGWYGFRHQNSEGTGQAADLKSTQAATDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8509 - protein, 566 aa, Artificial Sequence
  hemagglutinin__InfluenzaA__AFG72614
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGTSYSCKRGSVKSFFSRLNWLHKLEYKYPALNVAMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8510 - protein, 566 aa, Artificial Sequence
  hemagglutinin__InfluenzaA__AFG72625
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLIKSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8511 - protein, 566 aa, Artificial Sequence
  hemagglutinin__InfluenzaA__AFG72636
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVKSFFSRLNWLHKLEFKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8512 - protein, 566 aa, Artificial Sequence
  hemagglutinin__InfluenzaA__AFG72658
MKTIIALSYILCLAFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8513 - protein, 566 aa, Artificial Sequence
  hemagglutinin__InfluenzaA__AFG72680
MKTIIALSYILCLVFAQKLPGNDNSTATLCLGHHAVPNGTLVKTITNDQIEVTNATELVQSSSTGIICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTRRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINRKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8514 - protein, 566 aa, Artificial Sequence
  hemagglutinin__InfluenzaA__AFG72691
MKTIIALSYILCLVFAQKLPGNDNSTATLCLGHHAVPNGTLVKTITNDQIEVTNATELVQSSSTGRICDSPHRILDGKNCTLIDALLGDPHCDGFKNKEWDLFVERSTAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNGKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8515 - protein, 566 aa, Artificial Sequence
  hemagglutinin__InfluenzaA__AFG72713
MKIIIALSYILCLVFAQKLPGNDNSTATLCLGHHAVPNGTLVKTITNDQIEVTNATELVQSSSTGRICDSPHQILDGKNCTLIDALLGDPHCDGFKNKEWDLFVERSTAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLISSTGNLIAPRGYFKIRSGKSSIIRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8516 - protein, 566 aa, Artificial Sequence
  hemagglutinin__InfluenzaA__AFG72724
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNVCIGSIRNGTYDHDVYRDEALNNRFQIKGVELKSGYKDWILWISFAISCFLLCVVLLGFIMWACQKGNIRCNICI

SEQ ID NO: 8517 - protein, 566 aa, Artificial Sequence
  hemagglutinin__InfluenzaA__AFG72735
MKTIIALSYILCLVFAQKLPGNDNSTATLCLGHHAVPNGTLVKTITNDQIEVTNATELVQSSSTGRICDSPHRILDGKNCTLIDALLGDPHCDGFKNKEWDLFVERSTAYSNCYPYDVPDYASLRSLVASSGTLEFTNEGFNWTGVAQDGTSYACKRGSVKSFFSRLNWLHKLEYKYPALTVTMPNNDKFDKLYIWGVHHPSTDSDQTSIYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDIWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8518 - protein, 566 aa, Artificial Sequence
  hemagglutinin__InfluenzaA__AFG72757
MKTIIALSYILCLVFAQKIPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRSSIKSFFSRLNWLHQLKYKYPALNVTMPNNDKFDKLYIWGVHHPSTDSDQTSIYAQASGRVTVSTKRSQQTVIPNIGSRPWVRGISSRISIHWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8519 - protein, 566 aa, Artificial Sequence
  hemagglutinin__InfluenzaA__AFG72779
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNDKFDKLYIWGVHHPSTDSDQTSLYAQASGRVTVSTRRSQQTVIPNIGSRPWVRGVSSGISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8520 - protein, 566 aa, Artificial Sequence
  hemagglutinin__InfluenzaA__AFG72801
MKTIIALSYILCLVFAQKLPGNDNSTATLCLGHHAVSNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISIYAQSSGRVTVSTKRSQQTVIPNIGSSPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8521 - protein, 566 aa, Artificial Sequence
  hemagglutinin__InfluenzaA__AFG72812
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSNKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHLNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 8522 - protein, 566 aa, Artificial Sequence
  hemagglutinin__InfluenzaA__AFG72823
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVLHPGTDSDQISLYAQASGRITVSTKRSQQTVIPNIGSRPRVRGVSSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8523 - protein, 566 aa, Artificial Sequence
  hemagglutinin__InfluenzaA__AFG72834
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSNKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 8524 - protein, 566 aa, Artificial Sequence
  hemagglutinin__InfluenzaA__AFG72845
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLRYKYPALNVTMPNNEKFDKLYIWGVHHPGTDSDQISLYAQASGRVTISTKRSQQTVIPNIGSRPWVRGVSSRISIHWTIVKPGDILLINSTGNLIAPRGYFKIRSGKSSIMRSDAPIGKCNSECITPNGSIPNDKPFQNVNRITYGACPRYVKQKTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 8525 - protein, 566 aa, Artificial Sequence
  hemagglutinin__InfluenzaA__AFG72856
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFTNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNKLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8526 - protein, 566 aa, Artificial Sequence
  hemagglutinin__InfluenzaA__AFG72867
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSNKSFFSRLNWLHQLKNKYPALNVTMPNNEKFDKLYIWGVHHPGTDSDQISLYAQASGRVTVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 8527 - protein, 566 aa, Artificial Sequence
  hemagglutinin__InfluenzaA__AFG72922
MKTIIALSYILCLVFAQKLPGDDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSSCIRKSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8528 - protein, 566 aa, Artificial Sequence
  hemagglutinin__InfluenzaA__AFG72933
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACVRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8529 - protein, 566 aa, Artificial Sequence
  hemagglutinin__InfluenzaA__AFG72955
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLIASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8530 - protein, 566 aa, Artificial Sequence; identical to SEQ ID NO: 1640
  hemagglutinin__InfluenzaA__AFG98808

SEQ ID NO: 8531 - protein, 566 aa, Artificial Sequence; identical to SEQ ID NO: 1640
  hemagglutinin__InfluenzaA__AFG98819

SEQ ID NO: 8532 - protein, 566 aa, Artificial Sequence
  hemagglutinin__InfluenzaA__AFG98830
MKTIIALSYIFCLVLGQDLPGNDKSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFITEGFTWTGVTQNGGSSACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDILIINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8533 - protein, 566 aa, Artificial Sequence
  hemagglutinin__InfluenzaA__AFG98841
MKTIIALSYIFCLVLGQDLPGNDKSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDILIINSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8534 - protein, 566 aa, Artificial Sequence; identical to SEQ ID NO: 305
  hemagglutinin__InfluenzaA__AFG98852

SEQ ID NO: 8535 - protein, 566 aa, Artificial Sequence
  hemagglutinin__InfluenzaA__AFG98863
MKTIIALSYIFCLVLGQDLPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSSACKRGPDSGFFSRLNWLYKSGSTYPVLNVTMPNNDNFDKLYIWGVHHPSTNQEQTSLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFRIYHKCDNACIGSIRNGTYDHDVYRDEALNNRFQIKGVELKSGYKDWILWISFAISCFLLCVVLLGFIMWACQKGNIRCNICI

SEQ ID NO: 8536 - protein, 566 aa, Artificial Sequence
  hemagglutinin__InfluenzaA__AFG98874
MKTIIALSYIFCLVLGQDFPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGPDNGFFSRLNWLYKSGSTYPVLNVTMPNNDNFDKLYIWGVHHPSTDQEQTSLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8537 - protein, 566 aa, Artificial Sequence
  hemagglutinin__InfluenzaA__AFG98885
MKTIIALSYIFCLVLGQDFPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGTDSGFFSRLNWLYKSGSTYPVLNVTMPNNDNFDKLYIWGVHHPSTDQEQTSLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8538 - protein, 566 aa, Artificial Sequence
  hemagglutinin__InfluenzaA__AFG98896
MKTIIALSYIFCLVLGQDFPGNDNSTATLCLGHHAVPNGTLVKTITNDQIEVTNATELVQSSSTGKICNNPHRILDGINCTLIDALLGDPHCDGFQNETWDLFVERSKAFSNCYPYDVPDYASLRSLVASSGTLEFINEGFTWTGVTQNGGSNACKRGPDSGFFSRLNWLYKSGSAYPVLNVTMPNNDNFDKLYIWGVHHPSTDQEQTNLYVQTSGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8539 - protein, 566 aa, Artificial Sequence
  hemagglutinin__InfluenzaA__AFG98907
MKTIIALSYIFCLVLGQDLPGNDNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWTGVTQNGGSNACKRGPDCGFFSRLNWLYKSGSTYPVLNVTMPNNDNFDKLYIWGVHHPSTDQEQTNLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 8540 - protein, 566 aa, Artificial Sequence
  hemagglutinin__InfluenzaA__AFG98918
MKTIIALSYIFCLVLGQDLPGNDNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWTGVTQNGGSNACKRGPDRGFFSRLNWLYKSGSTYPVLNVTMPNNDNFDKLYIWGVHHPSTDQEQTNLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 8541 - protein, 566 aa, Artificial Sequence
  hemagglutinin__InfluenzaA__AFG98929
MKTVIALSYIFCLVLGQDLPGNDNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWTGVTQNGGSNACKRGPDIGFFSRLNWLYKSGSTYPVLNVTMPNNDNFDKLYIWGVHHPSTDQEQTNLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 8542 - protein, 566 aa, Artificial Sequence
  hemagglutinin__InfluenzaA__AFG98940
MKTIIALSYIFCLVLGQDLPGNDNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWTGVTQNGGSNACKRGPDSGFFSRLNWLYKSGSTYPVLNVTMPNKDNFDKLYIWGVHHPSTDQEQTNLYVQASGRVTVSTKRSQQTIIPNIGSRPWVRGMSSRISIYWTIVKPGDILVINSNGNLIAPRGYFKMRTGRSSIMRSDAPIGTCISECITPNGSIPNDRPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYNHDVYRDEALNNRFQIKGVELKSGYKDWILWISFAISCFLLCVVLLGFIMWACQKGNIRCNICI

SEQ ID NO: 8543 - protein, 566 aa, Artificial Sequence
  hemagglutinin__InfluenzaA__AFG98962
MKTIIALSYIFCLVLAQDLPGNDNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWTGVTQNGGSNACKRGPDSGFFSRLNWLYKSGSTYPVLNVTMPNNDNFDKLYIWGVHHPSTDQEQTNLYVQASGRVTVSTKRSQQTIIPNVGSRPWVRGLSSRISIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8544 - protein, 566 aa, Artificial Sequence
  hemagglutinin__InfluenzaA__AFG98973
MKTIIALSYIFCLVLGQDFPRNDNSTATLCLGHHAVPNGTLVKTITNDQIEVTNANELVQSSSTGKICNNPHRILDGMDCTLIDALLGDPHCDGLQNETWDLFVERSKAFSNCYPYDVPDYASLRSLVASSGTLEFINEGFTWTGVTQNGGSNACKRGPDRGFFSRLNWLYKSGNTYPVLNVTMPNNDNFDKLYIWGVHHPSTDQDQTSLYVQASGRVTVSTKRSQQTVIPNIGPRPWVRGLSSGISIYWTIVKPGDILLINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHRCDNACIGSIRNGTYDHDVYRDEALNNRFQIKGVELKSGYKDWILWISFAISCFLLCVVLLGFIMWACQKGNIRCNICI

SEQ ID NO: 8545 - protein, 566 aa, Artificial Sequence
  hemagglutinin__InfluenzaA__AFG98984
MKTIIALSYIFCLVLGQDFPRNDNSTATLCLGHHAVPNGTLVKTITNDQIEVTNATELVQSSSTGKICNNPHRILDGMDCTLIDALLGDPHCDGLQNETWDLFVERSKAFSNCYPYDVPDYASLRSLVASSGTLEFINEGFTWTGVTQNGGSNACKRGPDRGFFSRLNWLYKSGNTYPVLNVTMPNNDNFDKLYIWGVHHPSTDQDQTSLYVQASGRVTVSTKRSQQTVIPNIGPRPWVRGLSSGISIYWTIVKPGDILLINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHRCDNACIGSIRNGTYDHDVYRDEALNNRFQIKGVELKSGYKDWILWISFAISCFLLCVVLLGFIMWACQKGNIRCNICI

SEQ ID NO: 8546 - protein, 567 aa, Artificial Sequence
  hemagglutinin__InfluenzaA__AFG98995
MKTIIALSYIFCLVFAQDLPGNDNNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWTGVTQNGGSNACKRGPDIGFFSRLNWLYKSGSTYPVQNVTMPNNDNSDKLYIWGVHHPSTDKEQTDLYVQASGKVTVSTKRSQQTIIPNVGSRPWVRGLSSRISIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8547 - protein, 566 aa, Artificial Sequence
  hemagglutinin__InfluenzaA__AFG99006
MKTIIALSYIFCLVLGQDFPRNDNSTATLCLGHHAVPNGTLVKTITNDQIEVTNATELVQSSSTGKICNNPHRILDGMDCTLIDALLGDPHCDGLQNETWDLFVERSKAFSNCYPYDVPDYASLRSLVASSGTLEFINEGFTWTGVTQNGGSNACKRGPDRGFFSRLNWLYKSGNTYPVLNVTMPNNDNFDKLYIWGVHHPSTDQDQTSLYVQASGRVTVSTKRSQQTVIPNIGPRPWVRGLSSRISIYWTIVKPGDILLINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHRCDNACIGSIRNGTYDHDVYRDEALNNRFQIKGVELKSGYKDWILWISFAISCFLLCVVLLGFIMWACQKGNIRCNICI

SEQ ID NO: 8548 - protein, 566 aa, Artificial Sequence; identical to SEQ ID NO: 764
  hemagglutinin__InfluenzaA__AFG99017

SEQ ID NO: 8549 - protein, 566 aa, Artificial Sequence
  hemagglutinin__InfluenzaA__AFG99028
MKTIIALSYIFCLVFAQDLPGNDNSTATLCLGHHAVPNGTLVKTITNDQIEVTNATELVQSSSTGKICGNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8550 - protein, 566 aa, Artificial Sequence
  hemagglutinin__InfluenzaA__AFG99039
MKTIIALSYIFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVAMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8551 - protein, 566 aa, Artificial Sequence; identical to SEQ ID NO: 764
  hemagglutinin__InfluenzaA__AFG99050

SEQ ID NO: 8552 - protein, 566 aa, Artificial Sequence
  hemagglutinin__InfluenzaA__AFG99061
MKTIIALSYIFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYIKQNTLKLATGMRNVPEKQTRGIFGAIAGFIENGWEGMIDGWYGFRHQNSEGTGQAADLKSTQAAIDQINGKLNKVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8553 - protein, 566 aa, Artificial Sequence
  hemagglutinin__InfluenzaA__AFG99072
MKTIIALSYIFCLVFAQDLPGNDNSTATLCLGHHAVPNGTLVKTITNDQIEVTNATELVQSSSTGKICDNPHRILDGKNCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMPNNDNSDRLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 8554 - protein, 566 aa, Artificial Sequence
  hemagglutinin__InfluenzaA__AFG99083
MKTIIALSYIFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDKGFFSRLNWLYKSGSTYPVQNVTMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMLTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIHDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8555 - protein, 566 aa, Artificial Sequence
  hemagglutinin__InfluenzaA__AFG99094
MKTIIALSYIFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSGACKRGPDNGFFSRLNWLYKSGSTYPVQNVTMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8556 - protein, 566 aa, Artificial Sequence
  hemagglutinin__InfluenzaA__AFG99116
MKTIIALSYIFCLVFAQNLPGNDNSTATLCLGHHAVPNGTLVKTITNDQIEVTNATELVQSSSTGRICDSPHRILDGKNCTLVDALLGDPHCDGFQNEKWDLFVERSKAFSNCYPYDVPDYASLRSLVASSGTLEFINESFNWTGVTQSGGSYACKRGSDNSFFSRLNWLYESESKYPVLNVTMPNNGNFDKLYIWGVHHPSTDKEQTNLYVRASGRVTVSTKRSQQTIIPNIGSRPWVRGLSSRISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8557 - protein, 566 aa, Artificial Sequence
  hemagglutinin__InfluenzaA__AFG99127
MKTIIALSYILCLVFAQNLPGNDNSTATLCLGHHAVPNGTLVKTITNDQIEVTNATELVQSSSTGRICDSPHRILDGKNCTLVDALLGDPHCDGFQNEKWDLFVERSKAFSNCYPYDVPDYASLRSLVASSGTLEFINESFNWTGVTQSGGSYACKRGSDNSFFSRLNWLYESESKYPVLNVTMPNNGNFDKLYIWGVHHPSTDKEQTNLYVRASGRVTVSTKRSQQTIIPNIGSRPWVRGLSSRISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8558 - protein, 566 aa, Artificial Sequence
  hemagglutinin__InfluenzaA__AFG99138
MKTIIALSYIFCLVFAQNLPGNDNSTATLCLGHHAVPNGTLVKTITNDQIEVTNATELVQSSSTGRICDSPHRILDGKNCTLVDALLGDPHCDGFQNEKWDLFVERSKAFSNCYPYDVPDYASLRSLVASSGTLEFINESFNWTGVTQSGGSSACKRGSDNSFFSRLNWLYESESKYPVLNVTMPNNGNFDKLYIWGVHHPSTDKEQTNLYVRASGRVTVSTKRNQQTVIPNIGSRPWVRGLSSRISIYWTIVKPGDILLINSNGNLIAPRGYFKIRNGKSSIMRSDAPIGTCSSECITPNGSIPNDKPFQNVNKITYGACPKYVKQNTLKLATGMRNVPEKQTRGIFGAIAGFIENGWEGMVDGWYGFRHRNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8559 - protein, 566 aa, Artificial Sequence
  hemagglutinin__InfluenzaA__AFG99149
MKTIIALSYILCLVFAQNLPGNDNSTATLCLGHHAVPNGTLVKTITNDQIEVTNATELVQSSSTGRICDSPHRILDGKNCTLIDALLGDPHCDGFQNEKWDLFVERSRAFSNCYPYDVPDYASLRSLVASSGTLEFINEGFNWTGVTQSGGSYACKRGSDNSFFSRLNWLYESESKYPVLNVTMPNNGKFDKLYIWGVHHPSTDKEQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDAEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8560 - protein, 566 aa, Artificial Sequence
  hemagglutinin__InfluenzaA__AFG99171
MKTIIALSYIFCLVFAQNLPGNDNSTATLCLGHHAVPNGTLVKTITNDQIEVTNATELVQSSSTGRICDSPHRILDGKNCTLVDALLGDPHCDGFQNEKWDLFVERSKAFSNCYPYDVPDYASLRSLVASSGTLEFTNESFNWTGVTQSGGSYACKRGSDNSFFSRLNWLYESESKYPVLNVTMPNNGNFDKLYIWGVHHPSTDKEQTNLYVRASGRVTVSTKRNQQTVIPNIGSRPWVRGLSSRISIYWTIVKPGDILLINSNGNLIAPRGYFKIRNGKSSIMRSDAPIGTCSSECITPNGSIPNDKPFQNVNKITYGACPKYVKQNTLKLATGMRNVPEKQTRGIFGAIAGFIENGWEGMVDGWYGFRHRNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8561 - protein, 566 aa, Artificial Sequence
  hemagglutinin__InfluenzaA__AFG99182
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYESEYKYPALNVTMPNNGKFDKLYIWGVHHPSTDKEQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8562 - protein, 566 aa, Artificial Sequence
  hemagglutinin__InfluenzaA__AFG99193
MKTIIALSYISCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYESESKYPALNVTMPNNGKFEKLYIWGVHHPSTDKEQTNLYVRASGRVTVSTKRSQQTVIPNIGPRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDMTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8563 - protein, 566 aa, Artificial Sequence
  hemagglutinin__InfluenzaA__AFG99204
MKTIIALSYIFCLGFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYKSESKYPALNVTMPNNGKFDKLYIWGVHHPSTDKEQTNLYVRASGRVTVSTKRSQQTVIPNIGSRPWVRGLSSRISIYWTIVKPGDILLINSTGNLIAPRGYFKIRTGKSSIIRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8564 - protein, 566 aa, Artificial Sequence
  hemagglutinin__InfluenzaA__AFG99215
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFIERSKAFSNCYPYDVPDYASLRSLVASSGTLEFINEGFNWTGVTQSGGSYACKRGSVNSFFSRLNWLYESEYKYPALNVTMPNNGKFDKLYIWGVHHPSTEKEQTNLYVRASGRVTVSTKRSQQTVTPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8565 - protein, 566 aa, Artificial Sequence
  hemagglutinin__InfluenzaA__AFG99226
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYESEYKYPALNVTMPNNGKFDKLYIWGVHHPSTDKEQTNLYVRASGRVTVSTKRSQQTVIPNIGSRPWVRGLSSRISIYWTIVKPGDILSINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8566 - protein, 566 aa, Artificial Sequence
  hemagglutinin__InfluenzaA__AFG99237
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEDFNWTGVTQSGGSYACKRESVNSFFSRLNWLYESEYKYPALNVTMPNNGKFEKLYIWGVHHPSTDKEQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVRQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8567 - protein, 566 aa, Artificial Sequence
  hemagglutinin__InfluenzaA__AFG99248
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSHACKRGSVNSFFSRLNWLHESEYKYPALNVTMPNNGKFDKLYIWGVHHPITDREQTNLYVRASGRVTVSTKRSQQTVIPNIGFRPWVRGLSSRISIYWTIVKPGDILLINSTGNLIAPRGYFKIRNGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8568 - protein, 566 aa, Artificial Sequence
  hemagglutinin__InfluenzaA__AFG99259
MKTIIALSYIFCLVFAQKLPGNDNSTATLCLGHHAVPNGTLVKTITNDQVEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVNSFFSRLNWLHKSEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8569 - protein, 566 aa, Artificial Sequence
  hemagglutinin__InfluenzaA__AFG99270
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHKSEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHHNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8570 - protein, 566 aa, Artificial Sequence
  hemagglutinin__InfluenzaA__AFG99281
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEEFNWTGVTQSGGSYACKRGSVNSFFSRLNWLHKSEYKYPALNVTMPNNGRFDKLYIWGVHHPSTDREQTNLYVRASGRVTVSTKRSQQTVIPNIGPRPWVRGLSSRISIYWTIVKPGDILLINSTGNLIAPRGYFKIHTGKSSIMRSDAPIGTCSSECITPNGSIPNDKPFQNVNKITYGACPRYVKQNTLKLATGMRNVPDKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8571 - protein, 566 aa, Artificial Sequence
  hemagglutinin__InfluenzaA__AFG99292
MKTIIALSYIFCLVFAQKLPGNDNSTATLCLGHHAVPNGTLVKTITNDQVEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8572 - protein, 566 aa, Artificial Sequence
  hemagglutinin__InfluenzaA__AFG99303
MKTIIALSYIFCLVVAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSISNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8573 - protein, 566 aa, Artificial Sequence
  hemagglutinin__InfluenzaA__AFG99314
MKTIIALSYIFCLVFAQKLPGNDNSTATLCLGHHAVPNGTLVKTITNDQIEVTNATELVQSSSTGRICDSPHRILDGKNCTLIDALLGDPHCDSFQNEKWDLFVERSKAYSNCYPYDVPDYASLRSLVASSGTLEFINEDFNWTGVTQSGGSYACKRGSVNSFFSRLNWLHESEYKYPALNVTMPNNGKFDKLYIWGIHHPSTDREQTNLYVRASGRVTVSTKRSQQTVIPNIGSRPWVRGLSSRISIYWTIVKPGDILLINSTGNLIAPRGYFKLRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8574 - protein, 566 aa, Artificial Sequence
  hemagglutinin__InfluenzaA__AFG99336
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHKSEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8575 - protein, 566 aa, Artificial Sequence
  hemagglutinin__InfluenzaA__AFG99347
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHKPEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIDKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8576 - protein, 566 aa, Artificial Sequence
  hemagglutinin__InfluenzaA__AFG99358
MKTIIALSHILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGLSSRISIYWTIVKPGDILLINSIGNLIAPRGYFKIRNGKSSIMRSDVPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8577 - protein, 566 aa, Artificial Sequence
  hemagglutinin__InfluenzaA__AFG99369
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWAGVAQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 8578 - protein, 566 aa, Artificial Sequence
  hemagglutinin__InfluenzaA__AFG99380
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8579 - protein, 566 aa, Artificial Sequence; identical to SEQ ID NO: 8578
  hemagglutinin__InfluenzaA__AFG99391

SEQ ID NO: 8580 - protein, 566 aa, Artificial Sequence
  hemagglutinin__InfluenzaA__AFG99402
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVNSFFSRLNWLHKSEYKYPALNVTMPNNGKFDKLYIWGVHHPVTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8581 - protein, 566 aa, Artificial Sequence
  hemagglutinin__InfluenzaA__AFG99413
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8582 - protein, 566 aa, Artificial Sequence
  hemagglutinin__InfluenzaA__AFG99424
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHKSEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8583 - protein, 566 aa, Artificial Sequence
  hemagglutinin__InfluenzaA__AFG99435
MKTIIALSYIFCLVFAQKLPGNDNSTATLCLGHHAVPNGTLVKTITNDQIEVTNATELVQNSSTGRICDSPHRILDGKNCTLIDALLGDPHCDGLQNKEWDLFVERSKAYSNCYPYDVPDYASLRSLVASSGTLEFTKEDFNWTGVAQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8584 - protein, 566 aa, Artificial Sequence; identical to SEQ ID NO: 8583
  hemagglutinin__InfluenzaA__AFG99446

SEQ ID NO: 8585 - protein, 566 aa, Artificial Sequence
  hemagglutinin__InfluenzaA__AFG99457
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFINEDFNWTGVAQSGGSYACKRGSVNSFFSRLNWLHKSEYKYPALNVTMPNNGKFDKLYIWGVHHPSTDRDQTSLYVRASGRVTVSTKRSQQTVIPNIGSRPWVRGQSSRISIYWTIVKPGDILLINSTGNLIAPRGYFKIRNGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8586 - protein, 566 aa, Artificial Sequence
  hemagglutinin__InfluenzaA__AFG99468
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMDKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8587 - protein, 566 aa, Artificial Sequence
  hemagglutinin__InfluenzaA__AFG99490
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFIERSKAYSNCYPYDVPDYASLRSLVASSGTLEFINEDFNWTGVAQSGESYACKRGSVKSFFSRLNWLHESEYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8588 - protein, 566 aa, Artificial Sequence
  hemagglutinin__InfluenzaA__AFG99501
MKTIIALSYIFCLVVAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYTCKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSISNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8589 - protein, 566 aa, Artificial Sequence
  hemagglutinin__InfluenzaA__AFG99512
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGDSYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8590 - protein, 566 aa, Artificial Sequence
  hemagglutinin__InfluenzaA__AFG99523
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESQYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8591 - protein, 566 aa, Artificial Sequence; identical to SEQ ID NO: 8487
  hemagglutinin__InfluenzaA__AFG99534

SEQ ID NO: 8592 - protein, 566 aa, Artificial Sequence; identical to SEQ ID NO: 8487
  hemagglutinin__InfluenzaA__AFG99545

SEQ ID NO: 8593 - protein, 566 aa, Artificial Sequence
  hemagglutinin__InfluenzaA__AFG99556
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEDFNWTGVAQSGESYACKRGSVKSFFSRLNWLHESDYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADRKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8594 - protein, 566 aa, Artificial Sequence; identical to SEQ ID NO: 8487
  hemagglutinin__InfluenzaA__AFG99567

SEQ ID NO: 8595 - protein, 566 aa, Artificial Sequence; identical to SEQ ID NO: 8487
  hemagglutinin__InfluenzaA__AFG99578

SEQ ID NO: 8596 - protein, 566 aa, Artificial Sequence; identical to SEQ ID NO: 8487
  hemagglutinin__InfluenzaA__AFG99589

SEQ ID NO: 8597 - protein, 566 aa, Artificial Sequence
  hemagglutinin__InfluenzaA__AFG99600
MKTIIALSYILCLVFAQKLPGNDNSTATLCLGHHAVPNGTLVKTITNDQIEVTNATELVQSSSTGRICDSPHRVLDGKNCTLIDALLGDPHCDGFQNKEWDLFVERSKAYSNCYPYDVPDYASLRSLVASSGTLEFTNEDFNWTGVAQSGESYACKRGSVKSFFSRLNWLHESDYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRIGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8598 - protein, 566 aa, Artificial Sequence; identical to SEQ ID NO: 8487
  hemagglutinin__InfluenzaA__AFG99611

SEQ ID NO: 8599 - protein, 566 aa, Artificial Sequence; identical to SEQ ID NO: 8487
  hemagglutinin__InfluenzaA__AFG99622

SEQ ID NO: 8600 - protein, 566 aa, Artificial Sequence; identical to SEQ ID NO: 8487
  hemagglutinin__InfluenzaA__AFG99633

SEQ ID NO: 8601 - protein, 566 aa, Artificial Sequence
  hemagglutinin__InfluenzaA__AFG99644
MKTIIALSYILCLVFAQKLPGNDNSTATLCLGHHAVPNGTLVKTITNDQIEVTNATELVQNSSTGRICDSPHRILDGKNCTLIDALLGDPHCDDFQNKEWDLFVERSKAYSNCYPYDVPDYASLRSLVAASGTLEFINEDFNWTGVAQSGESYACKRGSVKSFFSRLNWLHESEYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEIEGRIQNLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8602 - protein, 566 aa, Artificial Sequence
  hemagglutinin__InfluenzaA__AFG99655
MKTIIALSYILCLVFAQKLPGNDNSTATLCLGHHAVPNGTLVKTITNDQIEVTNATELVQNSSTGRICDSPHRILDGKNCTLIDALLGDPHCDDFQNKEWDLFVERSKAYSNCYPYDVPDYASLRSLVASSGTLEFINEDFNWTGVAQSGESYACKRGSVKSFFSRLNWLHESEYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEIEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8603 - protein, 566 aa, Artificial Sequence; identical to SEQ ID NO: 8602
  hemagglutinin__InfluenzaA__AFG99666

SEQ ID NO: 8604 - protein, 566 aa, Artificial Sequence; identical to SEQ ID NO: 2338
  hemagglutinin__InfluenzaA__AFG99677

SEQ ID NO: 8605 - protein, 566 aa, Artificial Sequence; identical to SEQ ID NO: 8487
  hemagglutinin__InfluenzaA__AFG99688

SEQ ID NO: 8606 - protein, 566 aa, Artificial Sequence
  hemagglutinin__InfluenzaA__AFG99701
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSNAYSNCYPYDVPDYASLRSLVASSGTLEFTNEDFNWTGVAQSGESYACKRGSVKSFFSRLNWLHESDYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGAELKSGYKDWILWISFAISCFLLCVVLLGFIMWACQKGNIRCNICI

SEQ ID NO: 8607 - protein, 566 aa, Artificial Sequence
  hemagglutinin__InfluenzaA__AFG99712
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYEVPDYASLRSLVASSGTLEFTNEDFNWTGVAQSGESYACKRGSVKSFFSRLNWLHESDYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8608 - protein, 566 aa, Artificial Sequence; identical to SEQ ID NO: 8487
  hemagglutinin__InfluenzaA__AFG99723

SEQ ID NO: 8609 - protein, 566 aa, Artificial Sequence; identical to SEQ ID NO: 8602
  hemagglutinin__InfluenzaA__AFG99734

SEQ ID NO: 8610 - protein, 566 aa, Artificial Sequence
  hemagglutinin__InfluenzaA__AFG99745
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGDSYACKRGSVKSFFSRLNWLHESEYKYPALNVTMPNNDKFDKLYIWGVHHPSTEREQTSLYIRASGRVTVSTKRSQQTVIPNIGSKPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACMGSIRNGTYDHDVYRDEALNNRFQIKGVELKSGYKDWILWISFAISCFLLCVVLLGFIMWACQKGNIRCNICI

SEQ ID NO: 8611 - protein, 566 aa, Artificial Sequence; identical to SEQ ID NO: 8487
  hemagglutinin__InfluenzaA__AFG99756

SEQ ID NO: 8612 - protein, 566 aa, Artificial Sequence
  hemagglutinin__InfluenzaA__AFG99767
MKTIIALSYILCLVFAQKLPGNDNSTATLCLGHHAVPNGTLVKTITNDQIEVTNATELVQSSSTGRICDSPHRILDGKNCTLIDALLGDPHCDDFQNKEWDLFVERSKAYSNCYPYDVPDYASLRSLVASSGTLEFINEDFNWTGVAQSGESYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8613 - protein, 566 aa, Artificial Sequence
  hemagglutinin__InfluenzaA__AFG99778
MKTIIALSYILCLVFAQKLPGNDNSTATLCLGHHAVPNGTLVKTLTNDQIEVTNATELVQSSSTGKICDSPHRILDGKNCTLIDALLGDPHCDGLQNKEWDLFVERSKAYSNCYPYDVPDYASLRSLVASSGTLEFINEDFNWTGVAQDGGSYACKRGSVNSFFSRLNWLHKSEYKYPALNVTMPNNGKVDKLYIWGVHHPSTDRDQTSLYVRASGRVTVSTKRSQQTVIPNIGSRPWVRGQSSRISIYWTIVKPGDILLINSTGNLIAPRGYFKIRNGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8614 - protein, 566 aa, Artificial Sequence; identical to SEQ ID NO: 8487
  hemagglutinin__InfluenzaA__AFG99789

SEQ ID NO: 8615 - protein, 566 aa, Artificial Sequence; identical to SEQ ID NO: 8602
  hemagglutinin__InfluenzaA__AFG99800

SEQ ID NO: 8616 - protein, 566 aa, Artificial Sequence
  hemagglutinin__InfluenzaA__AFG99811
MKTIIALSYILCLVFSQKLPGNDNSTATLCLGHHAVPNGTLVKTITNDQIEVTNATELVQNSSTGRICDSPHRILDGKNCTLIDALLGDPHCDDFQNKEWDLFVERSKAYSNCYPYDVPDYASLRSLVASSGTLEFINEDFNWTGVAQSGESYACKRGSVKSFFSRLNWLHESEYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEIEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8617 - protein, 566 aa, Artificial Sequence; identical to SEQ ID NO: 8487
  hemagglutinin__InfluenzaA__AFG99822

SEQ ID NO: 8618 - protein, 566 aa, Artificial Sequence; identical to SEQ ID NO: 8487
  hemagglutinin__InfluenzaA__AFG99833

SEQ ID NO: 8619 - protein, 566 aa, Artificial Sequence; identical to SEQ ID NO: 8487
  hemagglutinin__InfluenzaA__AFG99844

SEQ ID NO: 8620 - protein, 566 aa, Artificial Sequence
  hemagglutinin__InfluenzaA__AFG99855
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEDFNWTGVAQSGESYACKRGSVKSFFSRLNWLHESDYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPGKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8621 - protein, 566 aa, Artificial Sequence; identical to SEQ ID NO: 8487
  hemagglutinin__InfluenzaA__AFG99866

SEQ ID NO: 8622 - protein, 566 aa, Artificial Sequence; identical to SEQ ID NO: 8487
  hemagglutinin__InfluenzaA__AFG99877

SEQ ID NO: 8623 - protein, 566 aa, Artificial Sequence
  hemagglutinin__InfluenzaA__AFG99888
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGESYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 8624 - protein, 566 aa, Artificial Sequence; identical to SEQ ID NO: 8487
  hemagglutinin__InfluenzaA__AFG99899

SEQ ID NO: 8625 - protein, 566 aa, Artificial Sequence; identical to SEQ ID NO: 8487
  hemagglutinin__InfluenzaA__AFG99910

SEQ ID NO: 8626 - protein, 566 aa, Artificial Sequence; identical to SEQ ID NO: 8487
  hemagglutinin__InfluenzaA__AFG99921

SEQ ID NO: 8627 - protein, 566 aa, Artificial Sequence
  hemagglutinin__InfluenzaA__AFG99932
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGESYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8628 - protein, 566 aa, Artificial Sequence; identical to SEQ ID NO: 8487
  hemagglutinin__InfluenzaA__AFG99943

SEQ ID NO: 8629 - protein, 566 aa, Artificial Sequence
  hemagglutinin__InfluenzaA__AFG99954
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGDSYACKRGSVKSFFSRLNWLHESEYKYPALNVTMPNNDKFDKLYIWGVHHPSTEREQTSLYIRASGRVTVSTKRSQQTVIPNIGFKPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8630 - protein, 566 aa, Artificial Sequence
  hemagglutinin__InfluenzaA__AFG99965
MKTIIALSYILCLAFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEDFNWTGVAQSGESYACKRGSVKSFFSRLNWLHESDYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8631 - protein, 566 aa, Artificial Sequence; identical to SEQ ID NO: 8487
  hemagglutinin__InfluenzaA__AFG99976

SEQ ID NO: 8632 - protein, 566 aa, Artificial Sequence
  hemagglutinin__InfluenzaA__AFG99987
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQNGDSYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8633 - protein, 566 aa, Artificial Sequence
  hemagglutinin__InfluenzaA__AFG99998
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8634 - protein, 566 aa, Artificial Sequence; identical to SEQ ID NO: 8602
  hemagglutinin__InfluenzaA__AFH00021

SEQ ID NO: 8635 - protein, 566 aa, Artificial Sequence
  hemagglutinin__InfluenzaA__AFH00032
MKTIIALSYILCLVFAQKLPGNDNSTATLCLGHHAVPNGTLVKTITNDQIEVTNATELVQSSSTGKICDSPHRILDGKNCTLIDALLGDPHCDDFQNKEWDLFVERSKAYSNCYPYDVPDYASLRSLVASSGTLEFINEDFNWTGVAQSGDSYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNKLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8636 - protein, 566 aa, Artificial Sequence
  hemagglutinin__InfluenzaA__AFH00043
MKTIIALSYILCLVFAQKLPGNDNSTATLCLGHHAVPNGTLVKTITNDQIEVTNATELVQSSSTGKICDSPHRILDGKNCTLIDALLGDPHCDDFQNKEWDLFVERSKAYSNCYPYDVPDYASLRSLVASSGTLEFINEDFNWTGVAQSGDSYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDATIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNKLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8637 - protein, 566 aa, Artificial Sequence
  hemagglutinin__InfluenzaA__AFH00054
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQNGDSYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFHIKGVELKSGYKDWILWISFAISCFLLCVVLLGFIMWACQKGNIRCNICI

SEQ ID NO: 8638 - protein, 566 aa, Artificial Sequence
  hemagglutinin__InfluenzaA__AFH00065
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVIPNIGSRPWVRGQPSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8639 - protein, 566 aa, Artificial Sequence
  hemagglutinin__InfluenzaA__AFH00076
MKTIIALSYILCLVFAQKLPGNDNSTATLCLGHHAVPNGTLVKTITNDQIEVTNATELVQSSSTGKICDSPHRILDGKNCTLIDALLGDPHCDDFQNKEWDLFVERSKAYSNCYPYDVPDYASLRSLVASSGTLEFINEDFNWTGVAQSGDSYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8640 - protein, 566 aa, Artificial Sequence
  hemagglutinin__InfluenzaA__AFH00087
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSEAYSSCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGQSSRIGIYWTIVKPGDILLINSTGNLIAPRGYFKIRNGKSSIMRSDAPIGNCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8641 - protein, 566 aa, Artificial Sequence
  hemagglutinin__InfluenzaA__AFH00098
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVIPNIGSRPWVRGLPSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8642 - protein, 566 aa, Artificial Sequence
  hemagglutinin__InfluenzaA__AFH00109
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYTCKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8643 - protein, 566 aa, Artificial Sequence
  hemagglutinin__InfluenzaA__AFH00120
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFTMWACQKGNIRCNICI

SEQ ID NO: 8644 - protein, 566 aa, Artificial Sequence; identical to SEQ ID NO: 8498
  hemagglutinin__InfluenzaA__AFH00131

SEQ ID NO: 8645 - protein, 566 aa, Artificial Sequence
  hemagglutinin__InfluenzaA__AFH00153
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYIRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8646 - protein, 566 aa, Artificial Sequence
  hemagglutinin__InfluenzaA__AFH00164
MKTIIALSYILCLVFAQKLPGNDNSTATLCLGHHAVPNGTLVKTITNDQIEVTNATELVQSSSTGRICDSPHRILDGKNCTLMDALLGDPHCDGFQNKEWDLFVERSKAYSNCYPYDVPDYASLRSLVASSGTLEFINEDFNWTGVAQNGDSYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8647 - protein, 566 aa, Artificial Sequence
  hemagglutinin__InfluenzaA__AFH00175
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVKSFFSRLNWLHKLEYKYPALNVTMPNNGKFDKLYIWGVHHPSTDSDQTSLYVRASGRVTVSTKKSQQTVIPNIGSRPWVRGQSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8648 - protein, 566 aa, Artificial Sequence
  hemagglutinin__InfluenzaA__AFH00186
MKTIIALSHILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGQSSRISIYWTIVKPGDILLISSTGNLIAPRGYFKIRNGKSSIMRSDVPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELIVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8649 - protein, 566 aa, Artificial Sequence
  hemagglutinin__InfluenzaA__AFH00197
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYTCKRGSVNSFFSRLNWLHKLEYKYPALNVTMPNNGKFDKLYIWGVHHPSTDSDQTSLYVRASGRVTVSTKISQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8650 - protein, 566 aa, Artificial Sequence
  hemagglutinin__InfluenzaA__AFH00208
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQNGDSYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSVMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLSRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8651 - protein, 566 aa, Artificial Sequence
  hemagglutinin__InfluenzaA__AFH00219
MKTIIALSYILCLVFAQKLPGNDNSTATLCLGHHAVPNGTLVKTITNDQIEVTNATELVQSSSTGRICDSPHRILDGKNCTLIDALLGDPNCDGFQNKEWDLFVERSKAYSNCYPYDVPDYASLRSLVASSGTLEFTNEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGLSSRISIYWTIVKPGDILLINSTGNLIAPRGYFKIRNGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIDKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8652 - protein, 566 aa, Artificial Sequence
  hemagglutinin__InfluenzaA__AFH00230
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVKSFFSRLNWLHKLEYKYPALNVTMPNNGKFDKLYIWGVHHPSTNSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8653 - protein, 566 aa, Artificial Sequence; identical to SEQ ID NO: 1024
  hemagglutinin__InfluenzaA__AFH00241

SEQ ID NO: 8654 - protein, 566 aa, Artificial Sequence
  hemagglutinin__InfluenzaA__AFH00252
MKTIIALSYILCLVFAQKLPGNDNSTATLCLGHHAVPNGTLVKTITNDQIEVTNATELVQSSSTGRICDSPHRILDGKNCTLIDALLGDPHCDDFQNKEWDLFVERSKAYSNCYPYDVPDYASLRSLVASSGTLEFINEDFNWTGVAQSGDSYACKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8655 - protein, 566 aa, Artificial Sequence
  hemagglutinin__InfluenzaA__AFH00263
MKTIIALSYILHLVFAQKLPGNDNSTATLCLGHHAVPNGTLVKTITNDQIEVTNATELVQSSSTGRICDSPHRILDGKNCTLIDALLGDPNCDGFQNKEWDLFVERSKAYSNCYPYDVPDYASLRSLVASSGTLEFTNEDFNWTGVAQDGGSYACKRGSVNSFFSRLNWLHKLEYKYPALNVTMPNNGKFDKLYIWGVHHPSTDSVQTSLYVRASGKVTVSTKRSQQTVTPNIGSKPWVRGLSSRISIYWTIVKPGDILLINSTGNLIAPRGYFKIRNGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8656 - protein, 566 aa, Artificial Sequence
  hemagglutinin__InfluenzaA__AFH00274
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSGISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8657 - protein, 566 aa, Artificial Sequence
  hemagglutinin__InfluenzaA__AFH00285
MKTIIALSYILCLVFAQKLPGNDNSTATLCLGHHAVPNGTLVKTITNDQIEVTNATELVQSSSTGRICGSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGQSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8658 - protein, 566 aa, Artificial Sequence
  hemagglutinin__InfluenzaA__AFH00296
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 8659 - protein, 566 aa, Artificial Sequence
  hemagglutinin__InfluenzaA__AFH00307
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGQSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8660 - protein, 566 aa, Artificial Sequence; identical to SEQ ID NO: 8659
  hemagglutinin__InfluenzaA__AFH00318

SEQ ID NO: 8661 - protein, 566 aa, Artificial Sequence
  hemagglutinin__InfluenzaA__AFH00329
MKTIIALSYILCLVFAQKLPGNDNSTATLCLGHHAVPNGTLVKTITNDQIEVTNATELVQSSSTGRICDSHHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSIYVRASGRVTVSTKRSQQTVIPNIGSRPWVRGISSRISIYWTIVKPGDILLINSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 8662 - protein, 566 aa, Artificial Sequence
  hemagglutinin__InfluenzaA__AFH00340
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLISSTGNLIAPRGYFKIRNGKSSIMRSDAPIGNCSSECITPNGSIPNDKPFQNVNRITYGACPRYVKQNTLKLATGMRNIPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8663 - protein, 566 aa, Artificial Sequence
  hemagglutinin__InfluenzaA__AFH00351
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTKEGFNWTGVAQDGKSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIGNCNSECITPDGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNKKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8664 - protein, 566 aa, Artificial Sequence
  hemagglutinin__InfluenzaA__AFH00362
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 8665 - protein, 566 aa, Artificial Sequence
  hemagglutinin__InfluenzaA__AFH00384
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTKEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSIGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8666 - protein, 566 aa, Artificial Sequence
  hemagglutinin__InfluenzaA__AFH00395
MKAIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTKEGFNWTGVAQDGKSYACKRGSVNGFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLIKSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8667 - protein, 566 aa, Artificial Sequence
  hemagglutinin__InfluenzaA__AFH00417
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8668 - protein, 566 aa, Artificial Sequence; identical to SEQ ID NO: 988
  hemagglutinin__InfluenzaA__AFH00428

SEQ ID NO: 8669 - protein, 566 aa, Artificial Sequence
  hemagglutinin__InfluenzaA__AFH00439
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMSKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8670 - protein, 566 aa, Artificial Sequence
  hemagglutinin__InfluenzaA__AFH00450
MKTIIALSYILCLVFAQKLPGNDNSTATLCLGHHAVPNGTLVKTITNDQIEVTNATELVQSSSTGRICDGPHRIIDGKNCTLIDALLGDPHCDGFQNKEWDLFVERSKAYSNCYPYDVPDYASLRSLVASSGTLEFTNESFNWTGVAQNGTSYACKRGSVKSFFSRLNWLHKLEYKYPALNVTMPNNDKFDKLYIWGVHHPSTDSDQTSLYVQSSGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMIDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8671 - protein, 566 aa, Artificial Sequence
  hemagglutinin__InfluenzaA__AFH00461
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFINENFNWTGVAQDGKSYACKRGSVNSFFSRLNWLHKLDYKYPALNVTMPNNGKFDKLYIWGVHHPSTDSDQISLYVRSSGRVTVSTKRSQQTVIPDIGYRPWVRGLSSRISIYWTIVKPGDILLINSTGNLIAPRGYFKLRNGKSSIMRSDAPIGNCSSGCITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8672 - protein, 566 aa, Artificial Sequence
  hemagglutinin__InfluenzaA__AFH00472
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVSDYASLRSLVASSGTLEFNNESFNWTGVAQNGTSYACKRRSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8673 - protein, 566 aa, Artificial Sequence
  hemagglutinin__InfluenzaA__AFH00483
MKTIIALSYILCMVFAQKLPGNDNSTATLCLGHHAVPNGTLVKTITNDQIEVTNATELVQSSSTGKICDSPHRILDGKNCTLIDALLGDPHCDGFQNKEWDLFVERSKAYSNCYPYDVPDYASLRSLVASSGTLEFNNESFNWTGVAQNGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8674 - protein, 566 aa, Artificial Sequence
  hemagglutinin__InfluenzaA__AFH00494
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFINENFNWTGVAQDGKSYACKRGSVNSFFSRLNWLHKLEYKYPALNVTMPNNGKFDKLYIWGVHHPSTDSDQTSLYVRASGRVTVSTKRSQQTVIPDIGYRPWVRGQSSRIGIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 8675 - protein, 566 aa, Artificial Sequence
  hemagglutinin__InfluenzaA__AFH00505
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQISLYVQASGRVTVSTKRSQQTVIPNIGSRPWVRGVSSIISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8676 - protein, 566 aa, Artificial Sequence
  hemagglutinin__InfluenzaA__AFH00516
MKTIIALSYILCQVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLIKSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8677 - protein, 566 aa, Artificial Sequence
  hemagglutinin__InfluenzaA__AFH00527
MKTIIALSYILCLVFAQKIPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIHWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8678 - protein, 566 aa, Artificial Sequence
  hemagglutinin__InfluenzaA__AFH00538
MKTIIALSYILCLVFAQKIPGNDNSTATLCLGHHAVPNGTLVKTITNDQIEVTNATELVQRSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8679 - protein, 566 aa, Artificial Sequence
  hemagglutinin__InfluenzaA__AFH00549
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNDKFDKLYIWGVHHPSTDSDQTSLYAQAPGRVTVSTRRSQQTVIPNIGSRPWVRGVSSIISIYWTIVKPGDILLINSTGNLIAPRGYFKIRSGKSSIMRSDAPISKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8680 - protein, 566 aa, Artificial Sequence
  hemagglutinin__InfluenzaA__AFH00560
MKTIIALSYILCLVFAQKLPVNDNSTATLCLGHHAVPNGTLVKTITNDHIEVTNATELVQSSSTGRICDIPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEAEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 8681 - protein, 566 aa, Artificial Sequence
  hemagglutinin__InfluenzaA__AFH00571
MKTIIALSYILCLVFAQKLPVNDNSTATLCLGHHAVPNGTLVKTITNDNIEVTNATELVQSSSTGRICDSPHQILDGENCTLIDALLGDPHCDGFQNKEWDLFVERSTAYSNCYPYDVPDYASLRSLVASSGTLEFNNESFNWTGVDQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8682 - protein, 566 aa, Artificial Sequence
  hemagglutinin__InfluenzaA__AFH00582
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 8683 - protein, 566 aa, Artificial Sequence; identical to SEQ ID NO: 1305
  hemagglutinin__InfluenzaA__AFH00593

SEQ ID NO: 8684 - protein, 566 aa, Artificial Sequence; identical to SEQ ID NO: 1305
  hemagglutinin__InfluenzaA__AFH00604

SEQ ID NO: 8685 - protein, 566 aa, Artificial Sequence
  hemagglutinin__InfluenzaA__AFH00615
MKTIIALSYILCLVFAQKLPGNDNSTATLCLGHHAVPNGTIVKTITNDQIEVTNATELVQSSSTGGICNSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDIEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 8686 - protein, 566 aa, Artificial Sequence; identical to SEQ ID NO: 8277
  hemagglutinin__InfluenzaA__AFH00626

SEQ ID NO: 8687 - protein, 566 aa, Artificial Sequence
  hemagglutinin__InfluenzaA__AFH00637
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSSCKRRSNNSFFSRLNWLTHLKFKYPALNVTMPNNEKFDKLYIWGVHHPGTNNDQISLYTQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8688 - protein, 566 aa, Artificial Sequence
  hemagglutinin__InfluenzaA__AFH00648
MKTIIALSYILCLVFAQKLPGNDDSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSSCKRRSNNSFFSRLNWLTHLKFKYPALNVTMPNNEKFDKLYIWGVHHPVTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8689 - protein, 566 aa, Artificial Sequence
  hemagglutinin__InfluenzaA__AFH00659
MKTIIALSYILCLVFTQKLPGNDNSTATLCLGHHAVPNGTMVKTITNDQIEVTNATELVQSSSTGEICDSPHQILDGENCTLIDALLGDPQCDGFQNKKWDLFVERSKAHSNCYPYDVPDYASLRSLIASSGTLEFNNESFNWTGVTQNGTSSACKRRSDNSFFSRLNWLTHLKFKYPALNVTMPNNEEFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSGCITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8690 - protein, 566 aa, Artificial Sequence
  hemagglutinin__InfluenzaA__AFH00670
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVLHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8691 - protein, 566 aa, Artificial Sequence
  hemagglutinin__InfluenzaA__AFH00681
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFIERSKAYSNCYPYDVPDYASLRSLVASSGTLEFNNESFNWTGVTQNGTSSACIRRSNNSFFSRLNWLTHLKFKYPALNVTMPNKEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8692 - protein, 566 aa, Artificial Sequence; identical to SEQ ID NO: 1928
  hemagglutinin__InfluenzaA__AFH00692

SEQ ID NO: 8693 - protein, 566 aa, Artificial Sequence
  hemagglutinin__InfluenzaA__AFH00703
MKTIIALSYILCLVFAQKLPGNDNSTATLCLGHHAVPNGTIVKTITNDQIEVTNATELVQSSSTGKICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYSALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKMQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8694 - protein, 566 aa, Artificial Sequence
  hemagglutinin__InfluenzaA__AFH00714
MKTIIALSYIFCLVFAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSDKSFFSRLNWLYESESKYPVLNVTMPNNGNFDKLYIWGVHHPSTDKEQTNLYVRASGRVTVSTKRSQQTIIPNIGSRPWVRGLSSGISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8695 - protein, 566 aa, Artificial Sequence
  hemagglutinin__InfluenzaA__AFH00725
MKTIIALSYIFCLIFAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSDNSFFSRLNWLYESESKYPVLNVTMPNNGKFDKLYIWGVHHPSTDKEQTKLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8696 - protein, 566 aa, Artificial Sequence; identical to SEQ ID NO: 7066
  hemagglutinin__InfluenzaA__AFH00736

SEQ ID NO: 8697 - protein, 566 aa, Artificial Sequence
  hemagglutinin__InfluenzaA__AFH00747
MKTIIALSYIFCLVFAQKLPGNDNSTATLCLGHYAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVKSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8698 - protein, 566 aa, Artificial Sequence
  hemagglutinin__InfluenzaA__AFH00758
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGESYACKRGSVKSFFSRLNWLHESEYKYPALNVTMPNNGKFDKLYIWGVHHPSTDREQTKLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8699 - protein, 566 aa, Artificial Sequence
  hemagglutinin__InfluenzaA__AFH00769
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGESYTCKRGSVKSFFSRLNWLHESEYKYPALNVTMPNNDKFDKLYIWGVHHPSTDREQTSLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8700 - protein, 566 aa, Artificial Sequence
  hemagglutinin__InfluenzaA__AFH00780
MRAIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSDCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8701 - protein, 566 aa, Artificial Sequence
  hemagglutinin__InfluenzaA__AFH00791
MKTIIALSYILCLVFAQKLPGNDNSTATLCLGHHAVPNGTLVKTITNDQIEVTNATELVQGSSTGRICDSPHQILDGKNCTLIDALLGDPHCDGFQNKEWDLFVERSTAYSNCYPYDVPDYASLRSLVASSGTLEFTKEGFNWTGVAQDGTSYTCKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8702 - protein, 566 aa, Artificial Sequence; identical to SEQ ID NO: 1342
  hemagglutinin__InfluenzaA__AFH00802

SEQ ID NO: 8703 - protein, 566 aa, Artificial Sequence
  hemagglutinin__InfluenzaA__AFH00813
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRDIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8704 - protein, 566 aa, Artificial Sequence
  hemagglutinin__InfluenzaA__AFH00824
MKTIIALSYILRLVFAQKLPGNDNSTATLCLGHHAVPNGTIVKTITNDQIEVTNATELVQNSSIGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8705 - protein, 566 aa, Artificial Sequence
  hemagglutinin__InfluenzaA__AFH01407
MKTIIALSYILCLVFAQKLPGNDNSTATLCLGHHAVPNGTIVKTITNDQIEVTNATELVQSSSTGGICNSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 8706 - protein, 566 aa, Artificial Sequence
  hemagglutinin__InfluenzaA__AFH34940
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTGSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 8707 - protein, 566 aa, Artificial Sequence
  hemagglutinin__InfluenzaA__AFH34961
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVAASGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 8708 - protein, 566 aa, Artificial Sequence
  hemagglutinin__InfluenzaA__AFH34968
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVAASGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCNSACITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 8709 - protein, 566 aa, Artificial Sequence
  hemagglutinin__InfluenzaA__AFH34975
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWNGVTQNGTSSACIRRSNNSFFSRLNWLTHLNFKYPALNVTMPNNEQFDKLYIWGVHHPGTDKDQIFLYAQPSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8710 - protein, 566 aa, Artificial Sequence; identical to SEQ ID NO: 3411
  hemagglutinin__InfluenzaA__AFH74464

SEQ ID NO: 8711 - protein, 566 aa, Artificial Sequence; identical to SEQ ID NO: 2669
  hemagglutinin__InfluenzaA__AFH74465

SEQ ID NO: 8712 - protein, 566 aa, Artificial Sequence; identical to SEQ ID NO: 3430
  hemagglutinin__InfluenzaA__AFH74477

SEQ ID NO: 8713 - protein, 566 aa, Artificial Sequence
  hemagglutinin__InfluenzaA__AFH74488
MKTIIALSYILCLVFAQKLPGNDNSTATLCLGHHAVPNGTIVKTITNDQIEVTNATELVQSSSTGEICDNPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8714 - protein, 566 aa, Artificial Sequence; identical to SEQ ID NO: 3411
  hemagglutinin__InfluenzaA__AFH74499

SEQ ID NO: 8715 - protein, 566 aa, Artificial Sequence; identical to SEQ ID NO: 3613
  hemagglutinin__InfluenzaA__AFH74510

SEQ ID NO: 8716 - protein, 566 aa, Artificial Sequence
  hemagglutinin__InfluenzaA__AFH74521
MKTIIALSYILCLVFAQKIPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKSKYPALNVTMPNNEQFDKLYIWGVHHPGTDNDQIFLYAQASGRITVSTKRSQQTVIPNIGSRPRIRDIPSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKVDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8717 - protein, 566 aa, Artificial Sequence; identical to SEQ ID NO: 6988
  hemagglutinin__InfluenzaA__AFH74532

SEQ ID NO: 8718 - protein, 566 aa, Artificial Sequence; identical to SEQ ID NO: 3613
  hemagglutinin__InfluenzaA__AFH74543

SEQ ID NO: 8719 - protein, 566 aa, Artificial Sequence; identical to SEQ ID NO: 3613
  hemagglutinin__InfluenzaA__AFH74554

SEQ ID NO: 8720 - protein, 566 aa, Artificial Sequence; identical to SEQ ID NO: 3613
  hemagglutinin__InfluenzaA__AFH74565

SEQ ID NO: 8721 - protein, 566 aa, Artificial Sequence; identical to SEQ ID NO: 3613
  hemagglutinin__InfluenzaA__AFH74576

SEQ ID NO: 8722 - protein, 566 aa, Artificial Sequence; identical to SEQ ID NO: 3613
  hemagglutinin__InfluenzaA__AFH74587

SEQ ID NO: 8723 - protein, 566 aa, Artificial Sequence
  hemagglutinin__InfluenzaA__AFH74598
MKTIIALSYILCLVFAQKLPENDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8724 - protein, 566 aa, Artificial Sequence; identical to SEQ ID NO: 3411
  hemagglutinin__InfluenzaA__AFH74609

SEQ ID NO: 8725 - protein, 566 aa, Artificial Sequence; identical to SEQ ID NO: 3613
  hemagglutinin__InfluenzaA__AFH74620

SEQ ID NO: 8726 - protein, 566 aa, Artificial Sequence
  hemagglutinin__InfluenzaA__AFH74631
MKTIIALSYILCLVFAQKLPGNDNSTATLCLGHHAVPNGTIVKTITNDQIEVTNATELVQSSSTGEICDSPHQILDGTNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8727 - protein, 566 aa, Artificial Sequence; identical to SEQ ID NO: 3411
  hemagglutinin__InfluenzaA__AFH74642

SEQ ID NO: 8728 - protein, 566 aa, Artificial Sequence; identical to SEQ ID NO: 3411
  hemagglutinin__InfluenzaA__AFH74653

SEQ ID NO: 8729 - protein, 566 aa, Artificial Sequence; identical to SEQ ID NO: 3411
  hemagglutinin__InfluenzaA__AFH74664

SEQ ID NO: 8730 - protein, 566 aa, Artificial Sequence; identical to SEQ ID NO: 3411
  hemagglutinin__InfluenzaA__AFH74675

SEQ ID NO: 8731 - protein, 566 aa, Artificial Sequence; identical to SEQ ID NO: 8159
  hemagglutinin__InfluenzaA__AFH74686

SEQ ID NO: 8732 - protein, 566 aa, Artificial Sequence; identical to SEQ ID NO: 8159
  hemagglutinin__InfluenzaA__AFH74697

SEQ ID NO: 8733 - protein, 566 aa, Artificial Sequence; identical to SEQ ID NO: 3613
  hemagglutinin__InfluenzaA__AFH74708

SEQ ID NO: 8734 - protein, 566 aa, Artificial Sequence; identical to SEQ ID NO: 3613
  hemagglutinin__InfluenzaA__AFH74719

SEQ ID NO: 8735 - protein, 566 aa, Artificial Sequence; identical to SEQ ID NO: 3613
  hemagglutinin__InfluenzaA__AFH74730

SEQ ID NO: 8736 - protein, 566 aa, Artificial Sequence
  hemagglutinin__InfluenzaA__AFH74741
MKTIIALSYILCLVFAQKLPGNDNSTATLCLGHHAVPNGTIVKTITNDQIEVTNATELVQNSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8737 - protein, 566 aa, Artificial Sequence; identical to SEQ ID NO: 3613
  hemagglutinin__InfluenzaA__AFH74752

SEQ ID NO: 8738 - protein, 566 aa, Artificial Sequence; identical to SEQ ID NO: 3613
  hemagglutinin__InfluenzaA__AFH74763

SEQ ID NO: 8739 - protein, 566 aa, Artificial Sequence; identical to SEQ ID NO: 3613
  hemagglutinin__InfluenzaA__AFH74774

SEQ ID NO: 8740 - protein, 566 aa, Artificial Sequence; identical to SEQ ID NO: 6988
  hemagglutinin__InfluenzaA__AFH74785

SEQ ID NO: 8741 - protein, 566 aa, Artificial Sequence; identical to SEQ ID NO: 3613
  hemagglutinin__InfluenzaA__AFH74796

SEQ ID NO: 8742 - protein, 566 aa, Artificial Sequence; identical to SEQ ID NO: 8169
  hemagglutinin__InfluenzaA__AFH74807

SEQ ID NO: 8743 - protein, 566 aa, Artificial Sequence; identical to SEQ ID NO: 8169
  hemagglutinin__InfluenzaA__AFH74818

SEQ ID NO: 8744 - protein, 566 aa, Artificial Sequence; identical to SEQ ID NO: 8169
  hemagglutinin__InfluenzaA__AFH74829

SEQ ID NO: 8745 - protein, 566 aa, Artificial Sequence; identical to SEQ ID NO: 8169
  hemagglutinin__InfluenzaA__AFH74840

SEQ ID NO: 8746 - protein, 566 aa, Artificial Sequence
  hemagglutinin__InfluenzaA__AFH74851
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYGNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLRLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8747 - protein, 566 aa, Artificial Sequence; identical to SEQ ID NO: 8172
  hemagglutinin__InfluenzaA__AFH74862

SEQ ID NO: 8748 - protein, 566 aa, Artificial Sequence; identical to SEQ ID NO: 8172
  hemagglutinin__InfluenzaA__AFH74873

SEQ ID NO: 8749 - protein, 566 aa, Artificial Sequence; identical to SEQ ID NO: 3613
  hemagglutinin__InfluenzaA__AFH74884

SEQ ID NO: 8750 - protein, 566 aa, Artificial Sequence; identical to SEQ ID NO: 3613
  hemagglutinin__InfluenzaA__AFH74895

SEQ ID NO: 8751 - protein, 566 aa, Artificial Sequence; identical to SEQ ID NO: 3613
  hemagglutinin__InfluenzaA__AFH74906

SEQ ID NO: 8752 - protein, 566 aa, Artificial Sequence; identical to SEQ ID NO: 3411
  hemagglutinin__InfluenzaA__AFH74917

SEQ ID NO: 8753 - protein, 566 aa, Artificial Sequence; identical to SEQ ID NO: 3613
  hemagglutinin__InfluenzaA__AFH74928

SEQ ID NO: 8754 - protein, 566 aa, Artificial Sequence; identical to SEQ ID NO: 3613
  hemagglutinin__InfluenzaA__AFH74939

SEQ ID NO: 8755 - protein, 566 aa, Artificial Sequence
  hemagglutinin__InfluenzaA__AFH74950
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYGNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8756 - protein, 566 aa, Artificial Sequence; identical to SEQ ID NO: 8172
  hemagglutinin__InfluenzaA__AFH74961

SEQ ID NO: 8757 - protein, 566 aa, Artificial Sequence; identical to SEQ ID NO: 3613
  hemagglutinin__InfluenzaA__AFH75388

SEQ ID NO: 8758 - protein, 566 aa, Artificial Sequence
  hemagglutinin__InfluenzaA__AFH97140
MKAILVVLLYIFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8759 - protein, 566 aa, Artificial Sequence
  hemagglutinin__InfluenzaA__AFJ05142
MKTIIALSYILCLVFAQKIPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNECFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSGCITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 8760 - protein, 566 aa, Artificial Sequence
  hemagglutinin__InfluenzaA__AFJ05144
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 8761 - protein, 566 aa, Artificial Sequence
  hemagglutinin__InfluenzaA__AFJ11706
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRSSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 8762 - protein, 566 aa, Artificial Sequence; identical to SEQ ID NO: 6982
  hemagglutinin__InfluenzaA__AFJ11728

SEQ ID NO: 8763 - protein, 566 aa, Artificial Sequence
  hemagglutinin__InfluenzaA__AFJ19842
MKTIIALSYILCLVFAQKLPGNDNSTATLCLGHHAVPNGTIVKTITNDQIEVTNATELVQSSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGIELKSGYKDWILWISFAISCFLLCVALLGFIMWACQKGNIRCNICI

SEQ ID NO: 8764 - protein, 566 aa, Artificial Sequence; identical to SEQ ID NO: 8361
  hemagglutinin__InfluenzaA__AFJ20171

SEQ ID NO: 8765 - protein, 566 aa, Artificial Sequence; identical to SEQ ID NO: 6982
  hemagglutinin__InfluenzaA__AFJ20182

SEQ ID NO: 8766 - protein, 566 aa, Artificial Sequence
  hemagglutinin__InfluenzaA__AFJ74386
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVMSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSGESKLNREKIDGVKLESMGVYQILAIYSTVASSLVLLVSLGAISFWMCSNGSLQCRICI

SEQ ID NO: 8767 - protein, 566 aa, Artificial Sequence
  hemagglutinin__InfluenzaA__AFJ74407
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8768 - protein, 566 aa, Artificial Sequence
  hemagglutinin__InfluenzaA__AFJ74418
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8769 - protein, 566 aa, Artificial Sequence
  hemagglutinin__InfluenzaA__AFJ74437
MKTIIALSYILCKVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8770 - protein, 566 aa, Artificial Sequence
  hemagglutinin__InfluenzaA__AFJ74448
MKTIIALSYILCLVFAQKLPGNDNSTATLCLGHHAVPNGTLVKTITNDQIEVTNATELVQSSSTGRICDSPHQILDGENCTLIDALLGGPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8771 - protein, 566 aa, Artificial Sequence
  hemagglutinin__InfluenzaA__AFJ74459
MEAKLLVLLCAFTATYADTICIGYHANNSTDTVDTVLEKNVTVTHSVNLLEDSHNGKLCRLKGTAPLQLGNCSIAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRNQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 8772 - protein, 566 aa, Artificial Sequence
  hemagglutinin__InfluenzaA__AFJ74470
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPSTDSDQISLYAQTSGRVTVSTKRSQQTVIPNIGSRPWVRGVSSRISIYWTIVKPGDILLINSTGNLIAPRGYFKIRSGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 8773 - protein, 566 aa, Artificial Sequence
  hemagglutinin__InfluenzaA__AFJ74492
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNKKFDKLYIWGVHHPSTDSDQISLYAQASGRVTVSTKRSQQTVIPNIGSRPWVRGVSSIISIYWTIVKPGDILLINSTGNLIAPRGYFKIRNGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFKIKGVELKSGYKDWILWISFAISCFLLCVVLLGFIMWACQKGNIRCNICI

SEQ ID NO: 8774 - protein, 566 aa, Artificial Sequence
  hemagglutinin__InfluenzaA__AFJ74525
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQDGTSSACKRRSIKSFFSRLNWLHQLKYKYPALNVTMPNNDKFDKLYIWGVHHPSTDSDQTSLYAQASGRVTVSTKRSQQTVIPNIGSRPWVRGVSSIISIYWTIVKPGDILLINSTGNLIAPRGYFKIRSGKSSIMRSDAPIGKCNSECITPNGSIPNDKPFQNVNRITYGTCPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8775 - protein, 566 aa, Artificial Sequence; identical to SEQ ID NO: 8773
  hemagglutinin__InfluenzaA__AFJ74535

SEQ ID NO: 8776 - protein, 566 aa, Artificial Sequence
  hemagglutinin__InfluenzaA__AFJ74560
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQTSGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLVEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 8777 - protein, 566 aa, Artificial Sequence
  hemagglutinin__InfluenzaA__AFJ74634
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTQLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8778 - protein, 565 aa, Artificial Sequence
  hemagglutinin__InfluenzaA__AFJ74653
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGYFADYEELREQLSSVSSFERFEIFPKESSWPNHTVTGVSASCSHNGKSSFYKNLLWLTGKNGLYPNLSKSYANNKEKEVLVLWGVHHPPNIGDQRALYHTDNAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8779 - protein, 565 aa, Artificial Sequence
  hemagglutinin__InfluenzaA__AFJ74673
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGYFADYEELREQLSSVSSFERFEIFPKESSWPNHTVTGVSASCSHNGKSSFYKNLLWLTGKNGLYPNLRKSYANNKEKEVLVLWGVHHPPNIGDQRALYHTDNAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8780 - protein, 566 aa, Artificial Sequence
  hemagglutinin__InfluenzaA__AFJ74674
MKTIIALSYILCLVFAQKLPGNDNSTATLCLGHHAVPNGTLVKTITNDQIEVTNATELVQSSSTGGICDSPHQILDGENCTLIDALLGDPHCDGFQNKKWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGRSSIMRSDAPIGKCNSECITPNGSIPNDKPFQNVNRITYGACPRYVKQNTLKLATGMRNVPEKQPRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8781 - protein, 565 aa, Artificial Sequence; identical to SEQ ID NO: 8778
  hemagglutinin__InfluenzaA__AFJ74694

SEQ ID NO: 8782 - protein, 566 aa, Artificial Sequence
  hemagglutinin__InfluenzaA__AFJ74695
MKTIIALSYILCLVFAQKLPGNDNSTATLCLGHHAVPNGTLVKTITNDQIEVTNATELVQNSSTGRICDSPHQILDGENCTLIDALLGDPHCDGFQNKEWDLFVERSKAYSNCYPYDVPDYVSLRSLVASSGTLEFNNESFNWTGVAQDGTSSACKRRSDKSFFSRLNWLHQLKYKYPALNVTMPNNEKFDKLYIWGVHHPGTDSDQISLYARASGRVTVSTKRSQQTVIPNIGSRPWVRGVSSKISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 8783 - protein, 566 aa, Artificial Sequence
  hemagglutinin__InfluenzaA__AFJ74727
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTQLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRSGTYDHDVYRDEALNNRFQIKGVELKSGYKDWILWISFAISCFLLCVALLGFIMWACQKGNIRCNICI

SEQ ID NO: 8784 - protein, 565 aa, Artificial Sequence; identical to SEQ ID NO: 8778
  hemagglutinin__InfluenzaA__AFJ74743

SEQ ID NO: 8785 - protein, 566 aa, Artificial Sequence; identical to SEQ ID NO: 8777
  hemagglutinin__InfluenzaA__AFJ74744

SEQ ID NO: 8786 - protein, 565 aa, Artificial Sequence; identical to SEQ ID NO: 8778
  hemagglutinin__InfluenzaA__AFJ74760

SEQ ID NO: 8787 - protein, 566 aa, Artificial Sequence
  hemagglutinin__InfluenzaA__AFJ74761
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTQLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8788 - protein, 565 aa, Artificial Sequence; identical to SEQ ID NO: 8778
  hemagglutinin__InfluenzaA__AFJ74779

SEQ ID NO: 8789 - protein, 566 aa, Artificial Sequence; identical to SEQ ID NO: 8777
  hemagglutinin__InfluenzaA__AFJ74780

SEQ ID NO: 8790 - protein, 566 aa, Artificial Sequence
  hemagglutinin__InfluenzaA__AFJ74804
MKTIIALSYILCLVFAQKLPGNDNSTATLCLGHHAVPNGTIVKTITNDQIEVTNATELVQSSSTGGICDSPHQILDGENCTLIDALLGDPQCDGFQNRKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8791 - protein, 566 aa, Artificial Sequence
  hemagglutinin__InfluenzaA__AFJ74819
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQINLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8792 - protein, 566 aa, Artificial Sequence; identical to SEQ ID NO: 2645
  hemagglutinin__InfluenzaA__AFJ74842

SEQ ID NO: 8793 - protein, 565 aa, Artificial Sequence
  hemagglutinin__InfluenzaA__AFJ75036
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKENSWPNHTVTGVSASCSHNGKSSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8794 - protein, 566 aa, Artificial Sequence; identical to SEQ ID NO: 630
  hemagglutinin__InfluenzaA__AFJ75047

SEQ ID NO: 8795 - protein, 565 aa, Artificial Sequence
  hemagglutinin__InfluenzaA__AFJ75058
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8796 - protein, 565 aa, Artificial Sequence
  hemagglutinin__InfluenzaA__AFJ75069
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKSNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8797 - protein, 566 aa, Artificial Sequence
  hemagglutinin__InfluenzaA__AFJ75091
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKISQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNADLLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8798 - protein, 566 aa, Artificial Sequence
  hemagglutinin__InfluenzaA__AFJ75449
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGKITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8799 - protein, 566 aa, Artificial Sequence
  hemagglutinin__InfluenzaA__AFJ75460
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAVDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8800 - protein, 565 aa, Artificial Sequence
  hemagglutinin__InfluenzaA__AFJ75517
MKVKLLVLLCTFTATYADTICIGYHANNSTDTVDTVLEKNVTVTYSVNLLEDNHNGKLCLLKGIAPLQLGNCSVAGWILGNPECELLISKESWSYIVERPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQMTLYHKKNAYVSVVSSHYSRKFTPEIAKRPKVRDQEGRINYYWTLLEPGDTIIFEANGNLIAPRYAFALNRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKTQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 8801 - protein, 565 aa, Artificial Sequence
  hemagglutinin__InfluenzaA__AFJ75560
MKVKLLVLLCTFTATYADTICIGYHANNSTDTVDTVLEKNVTVTHSVNLLEDNHNGKLCLLKGIAPLQLGNCSVAGWILGNPECELLISKESWSYIVERPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKFVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLRNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 8802 - protein, 565 aa, Artificial Sequence
  hemagglutinin__InfluenzaA__AFJ75571
MKVKLLVLLCTFTATYADTICIGYHANNSTDTVDTVLEKNVTVTHSVNLLEDNHNGKLCLLKGIAPLQLGNCSVAGWILGNPECELLISKESWSYIVERPNPENGTCYPGHFADYEELREQLSSVSSFERFEIFPKESSWPNHTVTGVSASCSHNGENSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSRERIDGVKLESMGVYQILAIYSTVASSLVLLVSLGAISFWMCSNGSLQCRICI

SEQ ID NO: 8803 - protein, 566 aa, Artificial Sequence
  hemagglutinin__InfluenzaA__AFJ75593
MKTIIALSYILCLVFAQKLPGNDSSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKVDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8804 - protein, 565 aa, Artificial Sequence
  hemagglutinin__InfluenzaA__AFJ75615
MKVKLLVLLCTFTATYADTICVGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTEVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8805 - protein, 566 aa, Artificial Sequence; identical to SEQ ID NO: 5352
  hemagglutinin__InfluenzaA__AFJ75630

SEQ ID NO: 8806 - protein, 566 aa, Artificial Sequence; identical to SEQ ID NO: 5352
  hemagglutinin__InfluenzaA__AFJ75641

SEQ ID NO: 8807 - protein, 565 aa, Artificial Sequence
  hemagglutinin__InfluenzaA__AFJ75651
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYRTENAYVSVVSSHYSRKFTPEIAKRPKVRDQEGRINYYWTLLEPGDTIIFEANGNLIAPRYAFALSRGFGSGIINSDAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8808 - protein, 566 aa, Artificial Sequence
  hemagglutinin__InfluenzaA__AFJ75662
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8809 - protein, 565 aa, Artificial Sequence
  hemagglutinin__InfluenzaA__AFJ75673
MKVKLLVLLCTFTATYADTICIGYHANNSTDTVDTVLEKNVTVTYSVNLLEDNHNGKLCLLKGIAPLQLGNCSVAGWILGNPECELLISKESWSYIVERPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGNQMTLYHKENAYVSVVSSHYSRKFTPEIAKRPKVRDQEGRINYYWTLLEPGDTIIFEANGNLIAPRYAFALNRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKTQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 8810 - protein, 566 aa, Artificial Sequence; identical to SEQ ID NO: 2669
  hemagglutinin__InfluenzaA__AFJ76119

SEQ ID NO: 8811 - protein, 566 aa, Artificial Sequence; identical to SEQ ID NO: 3022
  hemagglutinin__InfluenzaA__AFJ76131

SEQ ID NO: 8812 - protein, 566 aa, Artificial Sequence
  hemagglutinin__InfluenzaA__AFJ76155
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERKAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8813 - protein, 565 aa, Artificial Sequence
  hemagglutinin__InfluenzaA__AFJ76186
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEITKRPKVRDQEGRINYYWTLLEPGDTIIFEANGNLIAPRYAFALSRGFGSGIINSDAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8814 - protein, 566 aa, Artificial Sequence; identical to SEQ ID NO: 2669
  hemagglutinin__InfluenzaA__AFJ76203

SEQ ID NO: 8815 - protein, 566 aa, Artificial Sequence
  hemagglutinin__InfluenzaA__AFJ76213
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHSKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8816 - protein, 566 aa, Artificial Sequence
  hemagglutinin__InfluenzaA__AFJ77408
MKTIIALSYILCLIFAQKLPGNDNSTATLCLGHHAVPNGTLVKTITNDQIEVTNATELVQSSSTGRICNSPHRILDGENCTLIDALLGDPHCDGFQNKEWDLFVERSKAYSNCYPYDVPDYASLRSLVASSGTLEFTKEGFNWTGVAQDGKSYSCKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8817 - protein, 566 aa, Artificial Sequence
  hemagglutinin__InfluenzaA__AFJ77430
MKTIIALSYILCLIFAQKLPGNDNSTATLCLGHHAVPNGTLVKTITNDQIEVTNATELVQSSSTGRICDSPHRILDGENCTLIDALLGDPNCDGFQNKEWDLFVERSKAYSNCYPYDVPDYASLRSLVASSGTLEFTKEGFNWTGVAQDGKSYSCKRGSVNSFFSRLNWLHKLEYKYPALNVTMPNNDKFDKLYIWGVHHPSTDSDQISLYAQASGRVTVSTKRSQQTVIPNIGSRPWVRGISSRISIYWTIVKPGDILLINSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8818 - protein, 566 aa, Artificial Sequence
  hemagglutinin__InfluenzaA__AFJ77440
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTSEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8819 - protein, 566 aa, Artificial Sequence
  hemagglutinin__InfluenzaA__AFJ77451
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNGKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8820 - protein, 566 aa, Artificial Sequence
  hemagglutinin__InfluenzaA__AFJ77462
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8821 - protein, 566 aa, Artificial Sequence
  hemagglutinin__InfluenzaA__AFJ77473
MKTIIALSYILCQVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8822 - protein, 566 aa, Artificial Sequence; identical to SEQ ID NO: 186
  hemagglutinin__InfluenzaA__AFJ77484

SEQ ID NO: 8823 - protein, 566 aa, Artificial Sequence; identical to SEQ ID NO: 188
  hemagglutinin__InfluenzaA__AFJ77495

SEQ ID NO: 8824 - protein, 566 aa, Artificial Sequence; identical to SEQ ID NO: 186
  hemagglutinin__InfluenzaA__AFJ77506

SEQ ID NO: 8825 - protein, 566 aa, Artificial Sequence
  hemagglutinin__InfluenzaA__AFJ77517
MKTIIALSYILCLVFAQKIPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSNACKRRSMKSFFSRLNWLHQLKYKYPALNVTMPNNDKFDKLYIWGVHHPSTDSDQTSLYAQASGRVTVSTQRSQQTVIPNIGSRPWVRGVSSRISIYWTIVKPGDILLINSTGNLIAPRGYFKIRSGKSSIIRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAMSCFLLCVVLLGFIMWACQKGNIRCNICI

SEQ ID NO: 8826 - protein, 566 aa, Artificial Sequence; identical to SEQ ID NO: 23
  hemagglutinin__InfluenzaA__AFJ77528

SEQ ID NO: 8827 - protein, 565 aa, Artificial Sequence
  hemagglutinin__InfluenzaA__AFJ77550
MKTIIALSYILCQVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCSICI

SEQ ID NO: 8828 - protein, 566 aa, Artificial Sequence
  hemagglutinin__InfluenzaA__AFJ77561
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPSTDSDQTSLYAQASGRVTVSTKRSQQTVIPNIGSRPWVRGVSSRISIYWTIVKPGDILLIYSTGNLIAPRGYFKIRSGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8829 - protein, 565 aa, Artificial Sequence
  hemagglutinin__InfluenzaA__AFJ77572
MKTIIALSYILCQVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCSICI

SEQ ID NO: 8830 - protein, 566 aa, Artificial Sequence
  hemagglutinin__InfluenzaA__AFJ77583
MKTIITLSYILCLVFAQKLPVKDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8831 - protein, 566 aa, Artificial Sequence
  hemagglutinin__InfluenzaA__AFJ77594
MKTIIALSYILCLVFAQKLPVKDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8832 - protein, 566 aa, Artificial Sequence
  hemagglutinin__InfluenzaA__AFJ77605
MKTIIALSYILCLIFAQKLPGNDNSTATLCLGHHAVPNGTLVKTITNDQIEVTNATELVQSSSTGKICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEAVNNRFQIKGVELKSGYKDWILWISFAISCFLLCVVLLGFIMWACQKGNIRCNICI

SEQ ID NO: 8833 - protein, 566 aa, Artificial Sequence
  hemagglutinin__InfluenzaA__AFJ77616
MKTIIALSYILCMVLAQKLPVKDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8834 - protein, 566 aa, Artificial Sequence
  hemagglutinin__InfluenzaA__AFJ77627
MKTIIALSYILCLVLAQKLPVKDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8835 - protein, 566 aa, Artificial Sequence
  hemagglutinin__InfluenzaA__AFJ77638
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECTTPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8836 - protein, 566 aa, Artificial Sequence
  hemagglutinin__InfluenzaA__AFJ77649
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINNTGNLIAPRGYFKIRNGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFKIKGVELKSGYKDWILWISFAISCFLLCVVLLGFIMWACQKGNIRCNICI

SEQ ID NO: 8837 - protein, 566 aa, Artificial Sequence; identical to SEQ ID NO: 203
  hemagglutinin__InfluenzaA__AFJ77660

SEQ ID NO: 8838 - protein, 566 aa, Artificial Sequence; identical to SEQ ID NO: 203
  hemagglutinin__InfluenzaA__AFJ77671

SEQ ID NO: 8839 - protein, 566 aa, Artificial Sequence; identical to SEQ ID NO: 203
  hemagglutinin__InfluenzaA__AFJ77682

SEQ ID NO: 8840 - protein, 566 aa, Artificial Sequence
  hemagglutinin__InfluenzaA__AFJ77693
MKTIIALSYILCLVFAQKLPVNDNSTATLCLGHHTVPNGTLVKTITNDNIEVTNATELVQSSSTGRICDSPHQILDGENCTLIDALLGDPHCDGFQNKEWDLFVERSTAYSNCYPYDVPDYASLRSLVASSGTLEFNNESFNWTGVDQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNFEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8841 - protein, 566 aa, Artificial Sequence; identical to SEQ ID NO: 203
  hemagglutinin__InfluenzaA__AFJ77704

SEQ ID NO: 8842 - protein, 566 aa, Artificial Sequence; identical to SEQ ID NO: 8681
  hemagglutinin__InfluenzaA__AFJ77715

SEQ ID NO: 8843 - protein, 566 aa, Artificial Sequence; identical to SEQ ID NO: 8681
  hemagglutinin__InfluenzaA__AFJ77726

SEQ ID NO: 8844 - protein, 566 aa, Artificial Sequence; identical to SEQ ID NO: 8777
  hemagglutinin__InfluenzaA__AFJ77737

SEQ ID NO: 8845 - protein, 566 aa, Artificial Sequence; identical to SEQ ID NO: 32
  hemagglutinin__InfluenzaA__AFJ77748

SEQ ID NO: 8846 - protein, 566 aa, Artificial Sequence; identical to SEQ ID NO: 32
  hemagglutinin__InfluenzaA__AFJ77759

SEQ ID NO: 8847 - protein, 566 aa, Artificial Sequence
  hemagglutinin__InfluenzaA__AFJ77781
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNSESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8848 - protein, 566 aa, Artificial Sequence; identical to SEQ ID NO: 1795
  hemagglutinin__InfluenzaA__AFJ77792

SEQ ID NO: 8849 - protein, 566 aa, Artificial Sequence; identical to SEQ ID NO: 1795
  hemagglutinin__InfluenzaA__AFJ77803

SEQ ID NO: 8850 - protein, 566 aa, Artificial Sequence; identical to SEQ ID NO: 1795
  hemagglutinin__InfluenzaA__AFJ77814

SEQ ID NO: 8851 - protein, 566 aa, Artificial Sequence; identical to SEQ ID NO: 1795
  hemagglutinin__InfluenzaA__AFJ77825

SEQ ID NO: 8852 - protein, 566 aa, Artificial Sequence; identical to SEQ ID NO: 1795
  hemagglutinin__InfluenzaA__AFJ77836

SEQ ID NO: 8853 - protein, 566 aa, Artificial Sequence; identical to SEQ ID NO: 1795
  hemagglutinin__InfluenzaA__AFJ77847

SEQ ID NO: 8854 - protein, 566 aa, Artificial Sequence
  hemagglutinin__InfluenzaA__AFJ77858
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTQRSQQTVIPNIGSRPRVRDIPSRISIYWTIVKPGDMLLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNKLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLFCVALLGFIMWACQKGNIRCNICI

SEQ ID NO: 8855 - protein, 566 aa, Artificial Sequence
  hemagglutinin__InfluenzaA__AFJ77869
MKTIIAFSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8856 - protein, 566 aa, Artificial Sequence
  hemagglutinin__InfluenzaA__AFJ77880
MKTIIALSYILCLVFAQKLPGNDNSTATLCLGHHAVPNGTIVKTITNDQIEVTNATELVQSSSTGGICNSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8857 - protein, 566 aa, Artificial Sequence
  hemagglutinin__InfluenzaA__AFJ77902
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIGLYAQASGRITVSTKRSQQTVIPNIGSRPRVRDIPSRISIYWTIVKPGDMLLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8858 - protein, 566 aa, Artificial Sequence
  hemagglutinin__InfluenzaA__AFJ77913
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVQDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDMLLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8859 - protein, 566 aa, Artificial Sequence; identical to SEQ ID NO: 1113
  hemagglutinin__InfluenzaA__AFJ77924

SEQ ID NO: 8860 - protein, 566 aa, Artificial Sequence
  hemagglutinin__InfluenzaA__AFJ77935
MKTIIALSYILCLVFAQKLPGNDNSTATLCLGHHAVPNGTVVKTITNDQIEVTNATELVQSSSTGGICDSPHQILDGENCTLMDALLGDPQCDGFQNKKWDLFVERSKAYSNCYPYDVPDHASLRSLVASSGTLEFNNESFNWTGVTQNGTSSACKRRSNNSFFSRLNWLTHLKFKYPALNVTMPNNETFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8861 - protein, 566 aa, Artificial Sequence
  hemagglutinin__InfluenzaA__AFJ77946
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDMLLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWIIWISFAISCFLLCVALLGFIMWACQKGNIRCNICI

SEQ ID NO: 8862 - protein, 566 aa, Artificial Sequence; identical to SEQ ID NO: 1753
  hemagglutinin__InfluenzaA__AFJ77957

SEQ ID NO: 8863 - protein, 566 aa, Artificial Sequence; identical to SEQ ID NO: 630
  hemagglutinin__InfluenzaA__AFJ77968

SEQ ID NO: 8864 - protein, 566 aa, Artificial Sequence
  hemagglutinin__InfluenzaA__AFJ77979
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELRSGYKDWILWISFAISCFLLCVALLGFIMWACQKGNIRCNICI

SEQ ID NO: 8865 - protein, 566 aa, Artificial Sequence
  hemagglutinin__InfluenzaA__AFJ77990
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDEYRDEALNNRFQIKGVELKSGYKDWILWISFAISCFLLCVTLLGFIMWACQKGNIRCNICI

SEQ ID NO: 8866 - protein, 566 aa, Artificial Sequence
  hemagglutinin__InfluenzaA__AFJ78001
MKTIIALSYILCLVFAQKLPGNDNSTATLCLGHHAVPNGTIVKTITNDQIEVTNATELVQSSSTGGICDSPHQILDGKNCTLIDALLGDPQCDDFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVTLLGFIMWACQKGNIRCNICI

SEQ ID NO: 8867 - protein, 566 aa, Artificial Sequence
  hemagglutinin__InfluenzaA__AFJ78012
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAHSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8868 - protein, 566 aa, Artificial Sequence
  hemagglutinin__InfluenzaA__AFJ78023
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8869 - protein, 566 aa, Artificial Sequence; identical to SEQ ID NO: 630
  hemagglutinin__InfluenzaA__AFJ78034

SEQ ID NO: 8870 - protein, 566 aa, Artificial Sequence
  hemagglutinin__InfluenzaA__AFJ78045
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSRAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGMGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIKCNICI

SEQ ID NO: 8871 - protein, 566 aa, Artificial Sequence; identical to SEQ ID NO: 630
  hemagglutinin__InfluenzaA__AFJ78056

SEQ ID NO: 8872 - protein, 566 aa, Artificial Sequence
  hemagglutinin__InfluenzaA__AFJ78067
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGRSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8873 - protein, 566 aa, Artificial Sequence
  hemagglutinin__InfluenzaA__AFJ78078
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIDKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8874 - protein, 566 aa, Artificial Sequence; identical to SEQ ID NO: 8797
  hemagglutinin__InfluenzaA__AFJ78089

SEQ ID NO: 8875 - protein, 566 aa, Artificial Sequence; identical to SEQ ID NO: 1828
  hemagglutinin__InfluenzaA__AFJ78100

SEQ ID NO: 8876 - protein, 566 aa, Artificial Sequence
  hemagglutinin__InfluenzaA__AFJ78111
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8877 - protein, 566 aa, Artificial Sequence
  hemagglutinin__InfluenzaA__AFJ78122
MKTIIALSYILCLIFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGRSSIMRSDAPIDKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIRKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8878 - protein, 566 aa, Artificial Sequence
  hemagglutinin__InfluenzaA__AFJ78144
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSSCIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKVDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8879 - protein, 566 aa, Artificial Sequence; identical to SEQ ID NO: 8878
  hemagglutinin__InfluenzaA__AFJ78155

SEQ ID NO: 8880 - protein, 566 aa, Artificial Sequence
  hemagglutinin__InfluenzaA__AFJ78166
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKRQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8881 - protein, 566 aa, Artificial Sequence; identical to SEQ ID NO: 1729
  hemagglutinin__InfluenzaA__AFJ78177

SEQ ID NO: 8882 - protein, 566 aa, Artificial Sequence
  hemagglutinin__InfluenzaA__AFJ78188
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8883 - protein, 566 aa, Artificial Sequence
  hemagglutinin__InfluenzaA__AFJ78210
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGIELKSGYKDWILWISFAISCFLLCVALLGFIMWACQKGNIRCNICI

SEQ ID NO: 8884 - protein, 566 aa, Artificial Sequence; identical to SEQ ID NO: 8808
  hemagglutinin__InfluenzaA__AFJ78221

SEQ ID NO: 8885 - protein, 566 aa, Artificial Sequence
  hemagglutinin__InfluenzaA__AFJ78232
MKTIIALSYILCLVFAQKLPGNDNSTATLCLGHHAVPNGTIVKTITNDQIEVTNATELVQSSSTGKICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIENEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8886 - protein, 566 aa, Artificial Sequence
  hemagglutinin__InfluenzaA__AFJ78243
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAKASGRITVSTKRSQQTVIPNIGSRPRVRNIPSRISIYWTIVKPGDILLINSTGNLIAPRGYFKIRSGKSSIMRSDAPVGKCNSECITPNGSIPNDKPFQNVNRITYGACPRYVKQNTLKLATGMRNVPEKQTRGIFGAIAGFIENGWEGMVDGWYGFRHKNSEGTGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8887 - protein, 566 aa, Artificial Sequence
  hemagglutinin__InfluenzaA__AFJ78254
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKVDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8888 - protein, 566 aa, Artificial Sequence; identical to SEQ ID NO: 8887
  hemagglutinin__InfluenzaA__AFJ78265

SEQ ID NO: 8889 - protein, 566 aa, Artificial Sequence
  hemagglutinin__InfluenzaA__AFJ78276
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKVDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8890 - protein, 566 aa, Artificial Sequence
  hemagglutinin__InfluenzaA__AFJ78287
MKTIIALSYILCLVFAQKLPGNDNSTATLCLGHHAVPNGTIVKTITNDQIEVTNATELVQSSSTGEICDSPHQILDGKNCTLMDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 8891 - protein, 565 aa, Artificial Sequence
  hemagglutinin__InfluenzaA__AFJ78309
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPITIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 8892 - protein, 566 aa, Artificial Sequence
  hemagglutinin__InfluenzaA__AFJ78320
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 8893 - protein, 565 aa, Artificial Sequence
  hemagglutinin__InfluenzaA__AFJ78331
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 8894 - protein, 565 aa, Artificial Sequence; identical to SEQ ID NO: 8893
  hemagglutinin__InfluenzaA__AFJ78342

SEQ ID NO: 8895 - protein, 565 aa, Artificial Sequence; identical to SEQ ID NO: 8893
  hemagglutinin__InfluenzaA__AFJ78353

SEQ ID NO: 8896 - protein, 565 aa, Artificial Sequence
  hemagglutinin__InfluenzaA__AFJ78364
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTEKNGLYPNLSKSYVNNKEKEVLVLWGVHHPSNIGDQRAIYHTENAYVSVVSSHYNRRFTPEIAKRPKVRNQEGRINYYWTLLEPGDTIIFEANGNLIAPWYAFALSRGFGSGIITSNAPMDECDAKCQTPQGAINSSLPFQNVHPITIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 8897 - protein, 565 aa, Artificial Sequence
  hemagglutinin__InfluenzaA__AFJ78375
MKAKLLVLLCTFTATYADTICIGYHANNSTDTVDTVLEKNVTVTHSINLLENSHNGKLCLLKGIAPLQLGNCSVAGWILGNPECELLISKESWSYIVETPNPENGTCYPGHFADYEELREQLSSVSSFERFEIFPKESSWPNHTVTGVSASCSHNGKSSFYRNLLWLTEKNGLYPNLSKSYVNNKEKEVLVLWGVHHPSNIGDQRAIYHTENAYVSVVSSHYSRRFTPEIVKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 8898 - protein, 565 aa, Artificial Sequence; identical to SEQ ID NO: 1385
  hemagglutinin__InfluenzaA__AFJ78386

SEQ ID NO: 8899 - protein, 565 aa, Artificial Sequence; identical to SEQ ID NO: 1385
  hemagglutinin__InfluenzaA__AFJ78397

SEQ ID NO: 8900 - protein, 565 aa, Artificial Sequence; identical to SEQ ID NO: 8077
  hemagglutinin__InfluenzaA__AFJ78408

SEQ ID NO: 8901 - protein, 565 aa, Artificial Sequence
  hemagglutinin__InfluenzaA__AFJ78419
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGYFADYEELREQLSSVSSFERFEIFPKESSWPNHTVTGVSASCSHNGKSSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTVIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8902 - protein, 565 aa, Artificial Sequence
  hemagglutinin__InfluenzaA__AFJ78430
MKVKLLVLLCTFTATYADTICIGYHANNSTDTVDTVLEKNVTVTHSVNLLEDSHNGKLCLLKGIAPLQLGNCSVAGWILGNPECELLISRESWSYIVENPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGDQRALYHTENAYVSVVSSHYSRKFTPEIAKRPKVRDQEGRINYYWTLLGPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8903 - protein, 565 aa, Artificial Sequence
  hemagglutinin__InfluenzaA__AFJ78441
MKVKLMVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVDKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8904 - protein, 565 aa, Artificial Sequence
  hemagglutinin__InfluenzaA__AFJ78452
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGDQKALYHTENAYVSVVSSHYSRKFIPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8905 - protein, 565 aa, Artificial Sequence
  hemagglutinin__InfluenzaA__AFJ78463
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGKSSFYKNLLWLTGKNGLYPNLGKSYANNKEKEVLVLWGVHHPPNIGDQKALYHTENAYVSVVSSHYSRKFIPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8906 - protein, 565 aa, Artificial Sequence
  hemagglutinin__InfluenzaA__AFJ78474
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTVTGVSASCSYNGKSSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8907 - protein, 565 aa, Artificial Sequence
  hemagglutinin__InfluenzaA__AFJ78485
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVEDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8908 - protein, 565 aa, Artificial Sequence
  hemagglutinin__InfluenzaA__AFJ78496
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGGQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8909 - protein, 565 aa, Artificial Sequence
  hemagglutinin__InfluenzaA__AFJ78518
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8910 - protein, 565 aa, Artificial Sequence
  hemagglutinin__InfluenzaA__AFJ78529
MKVKLLVLLCTFTATYADTICIGYHANNSTDTVDTVLEKNVTVTHSVNLLEDNHNGKLCLLKGIAPLQLGNCSVAGWILGNPECELLISKESWSYIVERPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 8911 - protein, 565 aa, Artificial Sequence; identical to SEQ ID NO: 8910
  hemagglutinin__InfluenzaA__AFJ78540

SEQ ID NO: 8912 - protein, 565 aa, Artificial Sequence; identical to SEQ ID NO: 8910
  hemagglutinin__InfluenzaA__AFJ78551

SEQ ID NO: 8913 - protein, 565 aa, Artificial Sequence
  hemagglutinin__InfluenzaA__AFJ78562
MKVKLLVLLCTFTATYADTICIGYHANNSTDTVDTVLEKNVTVTHSVNLLEDNHNGKLCLLKGIAPLQLGNCSVAGWILGNPECELLISKESWSYIVERPNPENGTCYPGHFADYEELREQLSSVSSFERFEIFPKESSWPNHTVTGVSASCSHNGESSFYKNLLWLTGKNGLYPTLSKSYANNKEKEVLVLWGVHHPPNIGDQMTLYHKENAYVSVVSSHYSRKFTPEIAKRLKVRDQEGRINYYWTLLEPGDTIIFEANGNLIAPRYAFALSRGLGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 8914 - protein, 565 aa, Artificial Sequence
  hemagglutinin__InfluenzaA__AFJ78573
MKVKLLVLLCTFTATYADTICIGYHANNSTDTVDTVLEKNVTVTHSVNLLEDNHNGKLCLLKGIAPLQLGNCSVAGWILGNPECELLISKESWSYIVERPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEANGNLIAPRYAFALSRGFGSGIINSNASMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEEAKLSREKIDGVKLESMGVYQILAIYSTVASSLVLLVSLGAISFWMCSNGSLQCRICI

SEQ ID NO: 8915 - protein, 565 aa, Artificial Sequence
  hemagglutinin__InfluenzaA__AFJ78584
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTRKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVAIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8916 - protein, 565 aa, Artificial Sequence
  hemagglutinin__InfluenzaA__AFJ78595
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNREKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8917 - protein, 565 aa, Artificial Sequence
  hemagglutinin__InfluenzaA__AFJ78617
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHDGESSFYRNLLWLTGKNGLYPNLSKSYANNKEKEVLVLWGVHHPPSISDQKTLYHTENAHVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVSKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8918 - protein, 565 aa, Artificial Sequence
  hemagglutinin__InfluenzaA__AFJ78628
MKVKLLVLLCTFTATYADTICIGYHANNSTDTVDTVLEKNVTVTHSVNLLEDNHNGKLCLLKGIAPLQLGNCSVAGWILGNPECELLISKESWSYIVERPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGNQMTLYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 8919 - protein, 565 aa, Artificial Sequence
  hemagglutinin__InfluenzaA__AFJ78639
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISNQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 8920 - protein, 565 aa, Artificial Sequence; identical to SEQ ID NO: 8919
  hemagglutinin__InfluenzaA__AFJ78650

SEQ ID NO: 8921 - protein, 566 aa, Artificial Sequence; identical to SEQ ID NO: 2669
  hemagglutinin__InfluenzaA__AFJ78661

SEQ ID NO: 8922 - protein, 566 aa, Artificial Sequence
  hemagglutinin__InfluenzaA__AFJ78681
MKAILVVLLYTFATVNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8923 - protein, 566 aa, Artificial Sequence; identical to SEQ ID NO: 2669
  hemagglutinin__InfluenzaA__AFJ78691

SEQ ID NO: 8924 - protein, 566 aa, Artificial Sequence; identical to SEQ ID NO: 2669
  hemagglutinin__InfluenzaA__AFJ78701

SEQ ID NO: 8925 - protein, 566 aa, Artificial Sequence; identical to SEQ ID NO: 7197
  hemagglutinin__InfluenzaA__AFJ78711

SEQ ID NO: 8926 - protein, 566 aa, Artificial Sequence; identical to SEQ ID NO: 2669
  hemagglutinin__InfluenzaA__AFJ78721

SEQ ID NO: 8927 - protein, 566 aa, Artificial Sequence
  hemagglutinin__InfluenzaA__AFJ78731
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGSINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8928 - protein, 566 aa, Artificial Sequence; identical to SEQ ID NO: 3833
  hemagglutinin__InfluenzaA__AFJ78741

SEQ ID NO: 8929 - protein, 566 aa, Artificial Sequence; identical to SEQ ID NO: 2669
  hemagglutinin__InfluenzaA__AFJ78751

SEQ ID NO: 8930 - protein, 566 aa, Artificial Sequence; identical to SEQ ID NO: 2669
  hemagglutinin__InfluenzaA__AFJ78761

SEQ ID NO: 8931 - protein, 566 aa, Artificial Sequence; identical to SEQ ID NO: 2669
  hemagglutinin__InfluenzaA__AFJ78771

SEQ ID NO: 8932 - protein, 566 aa, Artificial Sequence; identical to SEQ ID NO: 2669
  hemagglutinin__InfluenzaA__AFJ78781

SEQ ID NO: 8933 - protein, 566 aa, Artificial Sequence; identical to SEQ ID NO: 2669
  hemagglutinin__InfluenzaA__AFJ78791

SEQ ID NO: 8934 - protein, 566 aa, Artificial Sequence; identical to SEQ ID NO: 2669
  hemagglutinin__InfluenzaA__AFJ78801

SEQ ID NO: 8935 - protein, 566 aa, Artificial Sequence; identical to SEQ ID NO: 3530
  hemagglutinin__InfluenzaA__AFJ78811

SEQ ID NO: 8936 - protein, 566 aa, Artificial Sequence; identical to SEQ ID NO: 2669
  hemagglutinin__InfluenzaA__AFJ78821

SEQ ID NO: 8937 - protein, 566 aa, Artificial Sequence; identical to SEQ ID NO: 2669
  hemagglutinin__InfluenzaA__AFJ78831

SEQ ID NO: 8938 - protein, 566 aa, Artificial Sequence; identical to SEQ ID NO: 3867
  hemagglutinin__InfluenzaA__AFJ78841

SEQ ID NO: 8939 - protein, 566 aa, Artificial Sequence; identical to SEQ ID NO: 2669
  hemagglutinin__InfluenzaA__AFJ78851

SEQ ID NO: 8940 - protein, 566 aa, Artificial Sequence
  hemagglutinin__InfluenzaA__AFJ78861
MKAILVVLLYTFATANADTLCIGYHANNSTDTVDTVLEKNVTVTHSVNLLEDKHNGKLCRLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8941 - protein, 566 aa, Artificial Sequence
  hemagglutinin__InfluenzaA__AFJ78881
MKAILVVLLYTFATANADTLCIGYHANNSTDTVDTVLEKNVTVTHSVNLLEDKHNGKLCKLRGVAPLHLGKCNIAGWILGNPECESLSTSSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTAASSLVLVVSLGAISFWMCSNGSLQCRICI

SEQ ID NO: 8942 - protein, 566 aa, Artificial Sequence; identical to SEQ ID NO: 2669
  hemagglutinin__InfluenzaA__AFJ78891

SEQ ID NO: 8943 - protein, 566 aa, Artificial Sequence; identical to SEQ ID NO: 2669
  hemagglutinin__InfluenzaA__AFJ78901

SEQ ID NO: 8944 - protein, 566 aa, Artificial Sequence; identical to SEQ ID NO: 2669
  hemagglutinin__InfluenzaA__AFJ78911

SEQ ID NO: 8945 - protein, 566 aa, Artificial Sequence; identical to SEQ ID NO: 2669
  hemagglutinin__InfluenzaA__AFJ78921

SEQ ID NO: 8946 - protein, 566 aa, Artificial Sequence
  hemagglutinin__InfluenzaA__AFJ97567
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPKGAINTSFPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8947 - protein, 566 aa, Artificial Sequence; identical to SEQ ID NO: 2669
  hemagglutinin__InfluenzaA__AFK14115

SEQ ID NO: 8948 - protein, 566 aa, Artificial Sequence; identical to SEQ ID NO: 2669
  hemagglutinin__InfluenzaA__AFK14131

SEQ ID NO: 8949 - protein, 566 aa, Artificial Sequence; identical to SEQ ID NO: 4351
  hemagglutinin__InfluenzaA__AFK14139

SEQ ID NO: 8950 - protein, 566 aa, Artificial Sequence
  hemagglutinin__InfluenzaA__AFK14148
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8951 - protein, 566 aa, Artificial Sequence; identical to SEQ ID NO: 4296
  hemagglutinin__InfluenzaA__AFK14157

SEQ ID NO: 8952 - protein, 566 aa, Artificial Sequence; identical to SEQ ID NO: 2669
  hemagglutinin__InfluenzaA__AFK14166

SEQ ID NO: 8953 - protein, 566 aa, Artificial Sequence; identical to SEQ ID NO: 3997
  hemagglutinin__InfluenzaA__AFK14175

SEQ ID NO: 8954 - protein, 566 aa, Artificial Sequence; identical to SEQ ID NO: 5574
  hemagglutinin__InfluenzaA__AFK14184

SEQ ID NO: 8955 - protein, 566 aa, Artificial Sequence; identical to SEQ ID NO: 3022
  hemagglutinin__InfluenzaA__AFK14193

SEQ ID NO: 8956 - protein, 566 aa, Artificial Sequence; identical to SEQ ID NO: 4266
  hemagglutinin__InfluenzaA__AFK14202

SEQ ID NO: 8957 - protein, 566 aa, Artificial Sequence; identical to SEQ ID NO: 3022
  hemagglutinin__InfluenzaA__AFK14211

SEQ ID NO: 8958 - protein, 566 aa, Artificial Sequence
  hemagglutinin__InfluenzaA__AFK14220
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSASSFERYEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8959 - protein, 566 aa, Artificial Sequence; identical to SEQ ID NO: 4296
  hemagglutinin__InfluenzaA__AFK14229

SEQ ID NO: 8960 - protein, 566 aa, Artificial Sequence; identical to SEQ ID NO: 7434
  hemagglutinin__InfluenzaA__AFK14238

SEQ ID NO: 8961 - protein, 566 aa, Artificial Sequence
  hemagglutinin__InfluenzaA__AFK14247
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAMNTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8962 - protein, 566 aa, Artificial Sequence
  hemagglutinin__InfluenzaA__AFK14272
MKAILIVLLYTFATANADTLCIGYHANNSTDTVDTVLEKNVTVTHSVNLLEDKHNGKLCKLTGVAPLHLGKCDIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8963 - protein, 566 aa, Artificial Sequence; identical to SEQ ID NO: 3022
  hemagglutinin__InfluenzaA__AFK14314

SEQ ID NO: 8964 - protein, 566 aa, Artificial Sequence
  hemagglutinin__InfluenzaA__AFK14323
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8965 - protein, 566 aa, Artificial Sequence; identical to SEQ ID NO: 7434
  hemagglutinin__InfluenzaA__AFK14332

SEQ ID NO: 8966 - protein, 566 aa, Artificial Sequence
  hemagglutinin__InfluenzaA__AFK14341
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENEKTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8967 - protein, 566 aa, Artificial Sequence; identical to SEQ ID NO: 4089
  hemagglutinin__InfluenzaA__AFK14350

SEQ ID NO: 8968 - protein, 566 aa, Artificial Sequence
  hemagglutinin__InfluenzaA__AFK14358
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGACYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENEKTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8969 - protein, 566 aa, Artificial Sequence
  hemagglutinin__InfluenzaA__AFK14395
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSENGMCCPRDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 8970 - protein, 566 aa, Artificial Sequence
  hemagglutinin__InfluenzaA__AFK14431
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFLDYEELRKQLSSVSSFERVEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8971 - protein, 566 aa, Artificial Sequence; identical to SEQ ID NO: 2669
  hemagglutinin__InfluenzaA__AFK14456

SEQ ID NO: 8972 - protein, 566 aa, Artificial Sequence; identical to SEQ ID NO: 2669
  hemagglutinin__InfluenzaA__AFK14465

SEQ ID NO: 8973 - protein, 566 aa, Artificial Sequence
  hemagglutinin__InfluenzaA__AFK14536
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETYSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8974 - protein, 566 aa, Artificial Sequence; identical to SEQ ID NO: 2669
  hemagglutinin__InfluenzaA__AFK14571

SEQ ID NO: 8975 - protein, 566 aa, Artificial Sequence; identical to SEQ ID NO: 7178
  hemagglutinin__InfluenzaA__AFK14586

SEQ ID NO: 8976 - protein, 566 aa, Artificial Sequence
  hemagglutinin__InfluenzaA__AFK14595
MKAILVVLLYTFATANADTLCIGYHANNSTDTVDTVLEKNVTVTHSVNLLEDKHNGKLCKLKGVAPLHLGKCNIAGWILGNPKCESLSTASSWSYIGETSSSNNGTCYPGNFIDFEELKKQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8977 - protein, 566 aa, Artificial Sequence; identical to SEQ ID NO: 7178
  hemagglutinin__InfluenzaA__AFK14612

SEQ ID NO: 8978 - protein, 566 aa, Artificial Sequence; identical to SEQ ID NO: 2669
  hemagglutinin__InfluenzaA__AFK14621

SEQ ID NO: 8979 - protein, 566 aa, Artificial Sequence
  hemagglutinin__InfluenzaA__AFK14630
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTRADLQSINQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8980 - protein, 566 aa, Artificial Sequence
  hemagglutinin__InfluenzaA__AFK14639
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRGQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8981 - protein, 566 aa, Artificial Sequence; identical to SEQ ID NO: 2669
  hemagglutinin__InfluenzaA__AFK14661

SEQ ID NO: 8982 - protein, 566 aa, Artificial Sequence; identical to SEQ ID NO: 7178
  hemagglutinin__InfluenzaA__AFK14670

SEQ ID NO: 8983 - protein, 566 aa, Artificial Sequence; identical to SEQ ID NO: 7178
  hemagglutinin__InfluenzaA__AFK14678

SEQ ID NO: 8984 - protein, 566 aa, Artificial Sequence
  hemagglutinin__InfluenzaA__AFK14688
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIHDEELRKQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERKAGSGIIILDTPVHDWNTTCETPKGAVNTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8985 - protein, 566 aa, Artificial Sequence; identical to SEQ ID NO: 7178
  hemagglutinin__InfluenzaA__AFK14697

SEQ ID NO: 8986 - protein, 566 aa, Artificial Sequence; identical to SEQ ID NO: 7178
  hemagglutinin__InfluenzaA__AFK14713

SEQ ID NO: 8987 - protein, 566 aa, Artificial Sequence; identical to SEQ ID NO: 7178
  hemagglutinin__InfluenzaA__AFK14722

SEQ ID NO: 8988 - protein, 566 aa, Artificial Sequence
  hemagglutinin__InfluenzaA__AFK14731
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELRKQLSSVSSFERVEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAVNTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8989 - protein, 566 aa, Artificial Sequence; identical to SEQ ID NO: 7178
  hemagglutinin__InfluenzaA__AFK14740

SEQ ID NO: 8990 - protein, 566 aa, Artificial Sequence; identical to SEQ ID NO: 7178
  hemagglutinin__InfluenzaA__AFK14749

SEQ ID NO: 8991 - protein, 566 aa, Artificial Sequence; identical to SEQ ID NO: 7178
  hemagglutinin__InfluenzaA__AFK14756

SEQ ID NO: 8992 - protein, 566 aa, Artificial Sequence; identical to SEQ ID NO: 7178
  hemagglutinin__InfluenzaA__AFK14764

SEQ ID NO: 8993 - protein, 566 aa, Artificial Sequence
  hemagglutinin__InfluenzaA__AFK14779
MKAILVVLLYTFATANADTLCIGYHANNSTDTVDTVLEKNVTVTHSVNLLEDKHNGKLCKLGGVAPLHLGKCNIAGWILGNPECESLSTASSWSYIVETSSSDNGTCYPGNFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8994 - protein, 566 aa, Artificial Sequence
  hemagglutinin__InfluenzaA__AFK14788
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLRKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 8995 - protein, 566 aa, Artificial Sequence
  hemagglutinin__InfluenzaA__AFK14798
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELRKQLSSVSSFERVEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPNGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8996 - protein, 566 aa, Artificial Sequence
  hemagglutinin__InfluenzaA__AFK14814
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSYERYEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8997 - protein, 566 aa, Artificial Sequence
  hemagglutinin__InfluenzaA__AFK14831
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFSDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 8998 - protein, 566 aa, Artificial Sequence; identical to SEQ ID NO: 2669
  hemagglutinin__InfluenzaA__AFK14839

SEQ ID NO: 8999 - protein, 566 aa, Artificial Sequence
  hemagglutinin__InfluenzaA__AFK14847
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSASSFERYEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9000 - protein, 566 aa, Artificial Sequence; identical to SEQ ID NO: 7178
  hemagglutinin__InfluenzaA__AFK14868

SEQ ID NO: 9001 - protein, 566 aa, Artificial Sequence; identical to SEQ ID NO: 3833
  hemagglutinin__InfluenzaA__AFK14884

SEQ ID NO: 9002 - protein, 566 aa, Artificial Sequence; identical to SEQ ID NO: 3833
  hemagglutinin__InfluenzaA__AFK14892

SEQ ID NO: 9003 - protein, 566 aa, Artificial Sequence; identical to SEQ ID NO: 3833
  hemagglutinin__InfluenzaA__AFK14901

SEQ ID NO: 9004 - protein, 566 aa, Artificial Sequence; identical to SEQ ID NO: 3833
  hemagglutinin__InfluenzaA__AFK14910

SEQ ID NO: 9005 - protein, 566 aa, Artificial Sequence; identical to SEQ ID NO: 2669
  hemagglutinin__InfluenzaA__AFK14919

SEQ ID NO: 9006 - protein, 566 aa, Artificial Sequence; identical to SEQ ID NO: 2669
  hemagglutinin__InfluenzaA__AFK14929

SEQ ID NO: 9007 - protein, 566 aa, Artificial Sequence; identical to SEQ ID NO: 8186
  hemagglutinin__InfluenzaA__AFK25599

SEQ ID NO: 9008 - protein, 566 aa, Artificial Sequence
  hemagglutinin__InfluenzaA__AFK25601
MKAILVVLLYTFATANADTLCIGYHANNSTDTVDTVLEKNVTVTHSVNLLEDKHNGKLCKLRGVAPLHLGKCNIAGWILGNPECVTLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 9009 - protein, 566 aa, Artificial Sequence; identical to SEQ ID NO: 8186
  hemagglutinin__InfluenzaA__AFK25603

SEQ ID NO: 9010 - protein, 566 aa, Artificial Sequence
  hemagglutinin__InfluenzaA__AFK25605
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVRSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 9011 - protein, 566 aa, Artificial Sequence; identical to SEQ ID NO: 8414
  hemagglutinin__InfluenzaA__AFK74526

SEQ ID NO: 9012 - protein, 566 aa, Artificial Sequence; identical to SEQ ID NO: 2669
  hemagglutinin__InfluenzaA__AFK74534

SEQ ID NO: 9013 - protein, 566 aa, Artificial Sequence; identical to SEQ ID NO: 2669
  hemagglutinin__InfluenzaA__AFK74544

SEQ ID NO: 9014 - protein, 566 aa, Artificial Sequence; identical to SEQ ID NO: 2669
  hemagglutinin__InfluenzaA__AFK74554

SEQ ID NO: 9015 - protein, 566 aa, Artificial Sequence; identical to SEQ ID NO: 2911
  hemagglutinin__InfluenzaA__AFK74564

SEQ ID NO: 9016 - protein, 566 aa, Artificial Sequence; identical to SEQ ID NO: 5224
  hemagglutinin__InfluenzaA__AFK74575

SEQ ID NO: 9017 - protein, 566 aa, Artificial Sequence; identical to SEQ ID NO: 2656
  hemagglutinin__InfluenzaA__AFK74585

SEQ ID NO: 9018 - protein, 566 aa, Artificial Sequence
  hemagglutinin__InfluenzaA__AFK74595
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDLNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9019 - protein, 566 aa, Artificial Sequence; identical to SEQ ID NO: 2669
  hemagglutinin__InfluenzaA__AFK74605

SEQ ID NO: 9020 - protein, 566 aa, Artificial Sequence; identical to SEQ ID NO: 2911
  hemagglutinin__InfluenzaA__AFK74615

SEQ ID NO: 9021 - protein, 566 aa, Artificial Sequence; identical to SEQ ID NO: 2911
  hemagglutinin__InfluenzaA__AFK74625

SEQ ID NO: 9022 - protein, 566 aa, Artificial Sequence; identical to SEQ ID NO: 3771
  hemagglutinin__InfluenzaA__AFK74635

SEQ ID NO: 9023 - protein, 566 aa, Artificial Sequence; identical to SEQ ID NO: 3771
  hemagglutinin__InfluenzaA__AFK74645

SEQ ID NO: 9024 - protein, 566 aa, Artificial Sequence; identical to SEQ ID NO: 2669
  hemagglutinin__InfluenzaA__AFK74655

SEQ ID NO: 9025 - protein, 566 aa, Artificial Sequence; identical to SEQ ID NO: 2669
  hemagglutinin__InfluenzaA__AFK74665

SEQ ID NO: 9026 - protein, 566 aa, Artificial Sequence; identical to SEQ ID NO: 2669
  hemagglutinin__InfluenzaA__AFK74675

SEQ ID NO: 9027 - protein, 566 aa, Artificial Sequence; identical to SEQ ID NO: 2669
  hemagglutinin__InfluenzaA__AFK74685

SEQ ID NO: 9028 - protein, 566 aa, Artificial Sequence; identical to SEQ ID NO: 5224
  hemagglutinin__InfluenzaA__AFK74695

SEQ ID NO: 9029 - protein, 566 aa, Artificial Sequence; identical to SEQ ID NO: 2669
  hemagglutinin__InfluenzaA__AFK74705

SEQ ID NO: 9030 - protein, 566 aa, Artificial Sequence; identical to SEQ ID NO: 2669
  hemagglutinin__InfluenzaA__AFK74715

SEQ ID NO: 9031 - protein, 566 aa, Artificial Sequence; identical to SEQ ID NO: 2669
  hemagglutinin__InfluenzaA__AFK74725

SEQ ID NO: 9032 - protein, 566 aa, Artificial Sequence; identical to SEQ ID NO: 2669
  hemagglutinin__InfluenzaA__AFK74735

SEQ ID NO: 9033 - protein, 566 aa, Artificial Sequence; identical to SEQ ID NO: 2669
  hemagglutinin__InfluenzaA__AFK74745

SEQ ID NO: 9034 - protein, 566 aa, Artificial Sequence; identical to SEQ ID NO: 2669
  hemagglutinin__InfluenzaA__AFK74755

SEQ ID NO: 9035 - protein, 566 aa, Artificial Sequence; identical to SEQ ID NO: 5224
  hemagglutinin__InfluenzaA__AFK74765

SEQ ID NO: 9036 - protein, 566 aa, Artificial Sequence; identical to SEQ ID NO: 2669
  hemagglutinin__InfluenzaA__AFK74775

SEQ ID NO: 9037 - protein, 566 aa, Artificial Sequence; identical to SEQ ID NO: 2669
  hemagglutinin__InfluenzaA__AFK74785

SEQ ID NO: 9038 - protein, 566 aa, Artificial Sequence; identical to SEQ ID NO: 2669
  hemagglutinin__InfluenzaA__AFK74795

SEQ ID NO: 9039 - protein, 566 aa, Artificial Sequence; identical to SEQ ID NO: 2669
  hemagglutinin__InfluenzaA__AFK74805

SEQ ID NO: 9040 - protein, 566 aa, Artificial Sequence; identical to SEQ ID NO: 2669
  hemagglutinin__InfluenzaA__AFK74815

SEQ ID NO: 9041 - protein, 566 aa, Artificial Sequence; identical to SEQ ID NO: 2669
  hemagglutinin__InfluenzaA__AFK74825

SEQ ID NO: 9042 - protein, 566 aa, Artificial Sequence; identical to SEQ ID NO: 2669
  hemagglutinin__InfluenzaA__AFK74835

SEQ ID NO: 9043 - protein, 566 aa, Artificial Sequence; identical to SEQ ID NO: 2669
  hemagglutinin__InfluenzaA__AFK74845

SEQ ID NO: 9044 - protein, 566 aa, Artificial Sequence; identical to SEQ ID NO: 2669
  hemagglutinin__InfluenzaA__AFK74895

SEQ ID NO: 9045 - protein, 566 aa, Artificial Sequence; identical to SEQ ID NO: 2669
  hemagglutinin__InfluenzaA__AFK74905

SEQ ID NO: 9046 - protein, 566 aa, Artificial Sequence; identical to SEQ ID NO: 2669
  hemagglutinin__InfluenzaA__AFK74915

SEQ ID NO: 9047 - protein, 566 aa, Artificial Sequence
  hemagglutinin__InfluenzaA__AFK74925
MKAILVVLLYTFATANADTLCIGYHANNSTDTVDTVLEKNVTVTHSVNLLEDKHNGKLCKLRGVVPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9048 - protein, 566 aa, Artificial Sequence; identical to SEQ ID NO: 3771
  hemagglutinin__InfluenzaA__AFK74935

SEQ ID NO: 9049 - protein, 566 aa, Artificial Sequence; identical to SEQ ID NO: 2669
  hemagglutinin__InfluenzaA__AFK74945

SEQ ID NO: 9050 - protein, 566 aa, Artificial Sequence; identical to SEQ ID NO: 2669
  hemagglutinin__InfluenzaA__AFK74955

SEQ ID NO: 9051 - protein, 566 aa, Artificial Sequence; identical to SEQ ID NO: 2669
  hemagglutinin__InfluenzaA__AFK74965

SEQ ID NO: 9052 - protein, 566 aa, Artificial Sequence; identical to SEQ ID NO: 2760
  hemagglutinin__InfluenzaA__AFK74975

SEQ ID NO: 9053 - protein, 566 aa, Artificial Sequence; identical to SEQ ID NO: 2669
  hemagglutinin__InfluenzaA__AFK74985

SEQ ID NO: 9054 - protein, 566 aa, Artificial Sequence; identical to SEQ ID NO: 5224
  hemagglutinin__InfluenzaA__AFK74995

SEQ ID NO: 9055 - protein, 566 aa, Artificial Sequence; identical to SEQ ID NO: 2669
  hemagglutinin__InfluenzaA__AFK75005

SEQ ID NO: 9056 - protein, 566 aa, Artificial Sequence
  hemagglutinin__InfluenzaA__AFK75015
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICV

SEQ ID NO: 9057 - protein, 566 aa, Artificial Sequence; identical to SEQ ID NO: 2911
  hemagglutinin__InfluenzaA__AFK75025

SEQ ID NO: 9058 - protein, 566 aa, Artificial Sequence; identical to SEQ ID NO: 2911
  hemagglutinin__InfluenzaA__AFK75035

SEQ ID NO: 9059 - protein, 566 aa, Artificial Sequence; identical to SEQ ID NO: 2911
  hemagglutinin__InfluenzaA__AFK75045

SEQ ID NO: 9060 - protein, 566 aa, Artificial Sequence; identical to SEQ ID NO: 2911
  hemagglutinin__InfluenzaA__AFK75055

SEQ ID NO: 9061 - protein, 566 aa, Artificial Sequence; identical to SEQ ID NO: 2669
  hemagglutinin__InfluenzaA__AFK75065

SEQ ID NO: 9062 - protein, 566 aa, Artificial Sequence; identical to SEQ ID NO: 2669
  hemagglutinin__InfluenzaA__AFK75075

SEQ ID NO: 9063 - protein, 566 aa, Artificial Sequence; identical to SEQ ID NO: 3833
  hemagglutinin__InfluenzaA__AFK75085

SEQ ID NO: 9064 - protein, 566 aa, Artificial Sequence; identical to SEQ ID NO: 3833
  hemagglutinin__InfluenzaA__AFK75095

SEQ ID NO: 9065 - protein, 566 aa, Artificial Sequence; identical to SEQ ID NO: 2669
  hemagglutinin__InfluenzaA__AFK75105

SEQ ID NO: 9066 - protein, 566 aa, Artificial Sequence; identical to SEQ ID NO: 2911
  hemagglutinin__InfluenzaA__AFK77857

SEQ ID NO: 9067 - protein, 566 aa, Artificial Sequence; identical to SEQ ID NO: 2911
  hemagglutinin__InfluenzaA__AFK77867

SEQ ID NO: 9068 - protein, 566 aa, Artificial Sequence; identical to SEQ ID NO: 8197
  hemagglutinin__InfluenzaA__AFK77877

SEQ ID NO: 9069 - protein, 566 aa, Artificial Sequence; identical to SEQ ID NO: 2669
  hemagglutinin__InfluenzaA__AFK77887

SEQ ID NO: 9070 - protein, 566 aa, Artificial Sequence
  hemagglutinin__InfluenzaA__AFK77897
MKAILVVLLYTFATANADTLCIGYHANNSTDTVDTVLEKNVTVTHSINLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9071 - protein, 566 aa, Artificial Sequence; identical to SEQ ID NO: 7050
  hemagglutinin__InfluenzaA__AFK78028

SEQ ID NO: 9072 - protein, 566 aa, Artificial Sequence; identical to SEQ ID NO: 2911
  hemagglutinin__InfluenzaA__AFK78187

SEQ ID NO: 9073 - protein, 566 aa, Artificial Sequence; identical to SEQ ID NO: 6855
  hemagglutinin__InfluenzaA__AFM45476

SEQ ID NO: 9074 - protein, 566 aa, Artificial Sequence
  hemagglutinin__InfluenzaA__AFM45487
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9075 - protein, 566 aa, Artificial Sequence; identical to SEQ ID NO: 6855
  hemagglutinin__InfluenzaA__AFM45489

SEQ ID NO: 9076 - protein, 566 aa, Artificial Sequence; identical to SEQ ID NO: 9074
  hemagglutinin__InfluenzaA__AFM45494

SEQ ID NO: 9077 - protein, 566 aa, Artificial Sequence
  hemagglutinin__InfluenzaA__AFM68954
MKARLLVLLCALAATDADTICIGYHANNSTDTVDTLLEKNVTVTHSVNLLEDSHNGKLCKLKGIAPLQLGKCNIAGWLLGNPECDSLLPARSWSYIVETPNSENGACYPGDFIDYEELKEQLSSVSSLERFEIFPKESSWPNHNTLKGVTASCSHGGKSSFYRNLLWLTKTEDSYPKLSNSYVNNKGKEVLVLWGVHHPSSSDEQQSLYHNVNAYVSVVSSNYNGRFTPEIAARPKVRNQPGRMNYYWTLLEPGDTIIFEATGNLIAPWYAFALSRGFGSGIITSNASMHECNTKCQTPQGAINSSLPFQNIHPVTIGECPKYVRSTKLRMVTGLRNIPSIQFRGLFGAIAGFIEGGWTGMIDGWYGYHHQNEQGSGYAADQKSTQNAINGITNKVNSVIEKMNTQFTAVSKEFNNLEKRMENLNKKVDDGFLDIWTYNAELLVLLENERTLDFHDLNVKNLYEKVKSQLKNNAKEIGNGCFEFYHKCDNKCMESVRNGTYDYPKYSEESKLNREKIDGVKLESMGVYQILAIYSTVASSLVLLVSLGAISFWMCSNGSLQCRICI

SEQ ID NO: 9078 - protein, 566 aa, Artificial Sequence
  hemagglutinin__InfluenzaA__AFM68965
MKTIIALSYIFCQVLAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQNGGSYACKRGPDNSFFSRLNWLYKSESTYPVLNVTMPNNDNFDKLYIWGVHHPSTDKEQTNLYVQASGRVTVSTKRSQQTIIPNVGSRPWVRGLSSGISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAKAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9079 - protein, 566 aa, Artificial Sequence
  hemagglutinin__InfluenzaA__AFM68987
MKTIIALSYIFCLVFAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSDKSFFSRLNWLYESESKYPVLNVTMPNNGNFDKLYIWGVHHPSTDKEQTNLYVRASGRVTVSTKRSQQTVIPNIGSRPWVRGLSSRISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9080 - protein, 566 aa, Artificial Sequence
  hemagglutinin__InfluenzaA__AFM71720
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVNSFFSRLNWLHESEYKYPALNVAMPNNGKFDKLYIWGVHHPITDREQTNLYVRASGRVTVSTKRSQQTVIPNIGSRPWVRGLSSRISIYWTIVKPGDILFINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9081 - protein, 566 aa, Artificial Sequence
  hemagglutinin__InfluenzaA__AFM71731
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGESYACKRGSVKSFFSRLNWLHKSEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9082 - protein, 566 aa, Artificial Sequence
  hemagglutinin__InfluenzaA__AFM71754
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFPYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYAHDVYRDEALNNRFQIKGVELKSGYKDWILWISFAISCFLLCVALLGFIMWACQKGNIRCNICI

SEQ ID NO: 9083 - protein, 566 aa, Artificial Sequence
  hemagglutinin__InfluenzaA__AFM71768
MKTIIALSYILCLVFAQKLPGNDNSTATLCLGHHAVPNGTIVKTITNDQIEVTNATELVQSSSTGEICDSPHQILDGKNCTLIDALLGDPQCDDFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFPYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYAHDVYRDEALNNRFQIKGVELKSGYKDWILWISFAISCFLLCVALLGFIMWACQKGNIRCNICI

SEQ ID NO: 9084 - protein, 566 aa, Artificial Sequence
  hemagglutinin__InfluenzaA__AFM71791
MKTIIALSYTLCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIELTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9085 - protein, 566 aa, Artificial Sequence
  hemagglutinin__InfluenzaA__AFM71824
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQDGTSSACIRRSKNSFFSRLNWLTHLNFKYPALNVTMPNNEQFDKLYIWGVHHPGTDKDQIFPYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9086 - protein, 566 aa, Artificial Sequence
  hemagglutinin__InfluenzaA__AFM71835
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSSCYPYDVPDYASLRSLVASSGTLEFNSESFNWTGVTQNGTSSACIRRSYNSFFSRLNWLTHLNFKYPALNVTMPNNEQFDKLYIWGVHHPGTDKDQIFPYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYIKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISLAISCFLLCVALLGFIMWACQKGNIRCNICI

SEQ ID NO: 9087 - protein, 565 aa, Artificial Sequence
  hemagglutinin__InfluenzaA__AFM71846
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPSNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 9088 - protein, 566 aa, Artificial Sequence; identical to SEQ ID NO: 2318
  hemagglutinin__InfluenzaA__AFM71857

SEQ ID NO: 9089 - protein, 566 aa, Artificial Sequence
  hemagglutinin__InfluenzaA__AFM71868
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSSCKRRSNNSFFSRLNWLTHLKFKYPALNVTMPNNEKFDKLYIWGVHHPVTDNDQIRLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9090 - protein, 566 aa, Artificial Sequence; identical to SEQ ID NO: 6998
  hemagglutinin__InfluenzaA__AFM71879

SEQ ID NO: 9091 - protein, 566 aa, Artificial Sequence
  hemagglutinin__InfluenzaA__AFM71890
MKARLLVLLCALAATDADTICIGYHANNSTDTVDTLLEKNVTVTHSVNLLEDSHNGKLCKLKGIAPLQLGKCNIAGWLLGNPECDSLLPARSWSYIVETPNSENGACYPGDFIDYEELKEQLSSVSSLERFEIFPKESSWPNHNTLKGVTASCSHGGKSSFYRNLLWLTKTEDSYPKLSNSYVNNKGKEVLVLWGVHHPSSSDEQQSLYHNVNAYVSVVSSNYNRRFTPEIAARPKVRNQPGRMNYYWTLLEPGDTIIFEATGNLIAPWYAFALSRGFGSGIITSNASMHECNTKCQTPQGAINSSLPFQNIHPVTIGECPKYVRSTKLRMVTGLRNIPSIQFRGLFGAIAGFIEGGWTGMIDGWYGYHHQNEQGSGYAADQKSTQNAINGITNKVNSVIEKMNTQFTAVSKEFNNLEKRMENLNKKVDDGFLDIWTYNAELLVLLENERTLDFHDLNVKNLYEKVKSQLKNNAKEIGNGCFEFYHKCDNKCMESVRNGTYDYPKYSEESKLNREKIDGVKLESMGVYQILAIYSTVASSLVLLVSLGAISFWMCSNGSLQCRICI

SEQ ID NO: 9092 - protein, 566 aa, Artificial Sequence; identical to SEQ ID NO: 9077
  hemagglutinin__InfluenzaA__AFM71901

SEQ ID NO: 9093 - protein, 566 aa, Artificial Sequence
  hemagglutinin__InfluenzaA__AFM71923
MKTIIALSYIFCLVLGQDLPGNDNSTATLCLGHHAVPNGTLVKTITNDQIEVTNATELVQSSSTGKICNNPHRILDGIDCTLIDALLGDPHCDSFQNETWDLFVERSKAFSNCYPYDVPDYASLRSLVASSGTLEFINEGFTWTGVTQNGGSNACKRGPDSGFFSRLNWLYKSGSTYPVLNVTMPNNDNFDKLYIWGVHHPSTNQEQTSLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFRIYHKCDNACIGSIRNGTYDHDVYRDEALNNRFQIKGVELKSGYKDWILWISFAISCFLLCVVLLGFIMWACQKGNIRCNICI

SEQ ID NO: 9094 - protein, 566 aa, Artificial Sequence
  hemagglutinin__InfluenzaA__AFM71934
MKTIIALSYIFCLVLGQDLPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGPDSGFFSRLNWLYKSGSTYPVLNVTMPNNDNFDKLYIWGVHHPSTNQEQTSLYVQASGRVTVSTKGSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFRIYHKCDNACIGSIRNGTYDHDVYRDEALNNRFQIKGVELKSGYKDWILWISFAISCFLLCVVLLGFIMWACQKGNIRCNICI

SEQ ID NO: 9095 - protein, 566 aa, Artificial Sequence
  hemagglutinin__InfluenzaA__AFM71945
MKTIIALSYIFCLVLGQDFPGNDNSTATLCLGHHAVPNGTLVKTITNDQIEVTNATELVQSSSTGKICNNPHRILDGINCTLIDALLGDPHCDGFQNETWDLFVERSKAFSNCYPYDVPDYASLRSLVASSGTLEFINEGFTWTGVTQNGGSNACKRGPDSGFFSRLNWLYKSGSAYPVLNVTMPNNDNFDKLYIWGVHHPSTDQEQTNLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9096 - protein, 566 aa, Artificial Sequence; identical to SEQ ID NO: 9095
  hemagglutinin__InfluenzaA__AFM71956

SEQ ID NO: 9097 - protein, 567 aa, Artificial Sequence
  hemagglutinin__InfluenzaA__AFM71978
MKTIIALSYIFCLVFAQDLPGNDNNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWTGVTQNGGSNACKRGPDSGFFSRLNWLYKSGSTYPVQNVTMPNNDNSDKLYIWGVHHPSTDKEQTNLYVQASGKVTVSTKRSQQTIIPNVGSRPWVRGLSSRISIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9098 - protein, 566 aa, Artificial Sequence
  hemagglutinin__InfluenzaA__AFM71989
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPSTDKDQIFLYTQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9099 - protein, 566 aa, Artificial Sequence
  hemagglutinin__InfluenzaA__AFM72010
MKTIIALSYIFCQVLAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQNGGSYACKRGPDKSFFSRLNWLYESESTYPVLNVTMPNNDNFDKLYIWGVHHPSTDKEQTKLYVQASGRVTVSTKRSQQTIIPNVGSRPWVRGLSSRISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9100 - protein, 566 aa, Artificial Sequence; identical to SEQ ID NO: 915
  hemagglutinin__InfluenzaA__AFM72021

SEQ ID NO: 9101 - protein, 566 aa, Artificial Sequence
  hemagglutinin__InfluenzaA__AFM72032
MKTIIALSYMFCLVFAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYTCKRGSNNSFFSRLNWLYESESKYPVLNVTMPNNGKFDKLYIWGIHHPSTDKEQTNLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9102 - protein, 566 aa, Artificial Sequence
  hemagglutinin__InfluenzaA__AFM72043
MKTIIALSYMFCLVFAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSSTCKRGSNNSFFSRLNWLYESESKYPVLNVTMPNNGKFDKLYIWGIHHPSTDKEQTNLYIRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9103 - protein, 566 aa, Artificial Sequence
  hemagglutinin__InfluenzaA__AFM72054
MKAKLLVLLCALSATDADTICIGYHANNSTDTVDTVLEKNVTVTHSVNLLEDNHNGKLCKLKGIAPLQLGKCSIAGWILGNPECESLFSKKSWSYIAETPNSENGTCYPGYFADYEELREQLSSVSSFERFEIFPKESSWPKHNVTKGVTAACSHKGKSSFYRNLLWLTEKNGSYPNLSKSYVNNKEKEVLVLWGVHHPSNIEDQKTIYRKENAYVSVVSSHYNRRFTPEIAKRPKVRNQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSIIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9104 - protein, 566 aa, Artificial Sequence; identical to SEQ ID NO: 9103
  hemagglutinin__InfluenzaA__AFM72065

SEQ ID NO: 9105 - protein, 566 aa, Artificial Sequence
  hemagglutinin__InfluenzaA__AFM72087
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFIERSKAFSNCYPYDVPDYASLRSLVASSGTLEFINEGFNWTGVTQSGGSYTCKRGSVNSFFSRLNWLYESEYKYPALNVTMPNNGKFDKLYIWGVHHPSTEKEQTNLYVRASGRVTVSTKRSQQTVIPNIGSSPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQYTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9106 - protein, 566 aa, Artificial Sequence
  hemagglutinin__InfluenzaA__AFM72098
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVNSFFSRLNWLYKSEYKYPALNVTMPNNGKFDKLYIWGVHHPVTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9107 - protein, 566 aa, Artificial Sequence
  hemagglutinin__InfluenzaA__AFM72109
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVNSFFSRLNWLHKSEYKYPALNVTMPNNGKFDKLYIWGVHHPITDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9108 - protein, 566 aa, Artificial Sequence
  hemagglutinin__InfluenzaA__AFM72120
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVNSFFSRLNWLHESEYKYPALNVTMPNNGKFDKLYIWGVHHPITDREQTNLYVRASGRVTVSTKRSQQTVIPNIGFRPWVRGLSSRISIYWTIVKPGDILLINSTGNLIAPRGYFKIRNGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9109 - protein, 566 aa, Artificial Sequence
  hemagglutinin__InfluenzaA__AFM72131
MKTIIALSYILCLVFAQKLPGNDNSTATLCLGHHAVPNGTLVKTITNDQIEVTNATELVQSSSTGRICDSPHRILDGKDCTLIDALLGDPHCDGFQNKEWDLFVERSKAYSNCYPYDVPDYASLRSLVASSGTLEFINEDFNWNGVAQSGESYACKRGSVKSFFSRLNWLHESEYKYPALNVTMPNNGKFDKLYIWGVHHPSTDREQTKLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9110 - protein, 566 aa, Artificial Sequence
  hemagglutinin__InfluenzaA__AFM72142
MKTIIALSYISCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDRDQTSLYVRASGRVTVSTKRSQQTVIPNIGSRPWVRGQSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9111 - protein, 566 aa, Artificial Sequence
  hemagglutinin__InfluenzaA__AFM72153
MKTIIALSYILCLVFAQKLPGNDNSTATLCLGHHAVPNGTLVKTITNDQIEVTNATELVQSSSTGRICGSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGQSSRIGIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9112 - protein, 566 aa, Artificial Sequence
  hemagglutinin__InfluenzaA__AFM72164
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFINENFNWTGVAQDGKSYACKRGSVNSFFSRLNWLHKLEYKYPALNVTMPNNGKFDKLYIWGVHHPSTDSDQTSLYVRASGRVTVSTKRSQQTVIPDIGYRPWVRGQSSRISIHWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9113 - protein, 566 aa, Artificial Sequence
  hemagglutinin__InfluenzaA__AFM72175
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFINENFNWTGVAQDGKSYACKRGSVNSFFSRLNWLHKLEYKYPALNVTMPNNGKFDKLYIWGVHHPSTDSDQTNLYVRASGRVTVSTKRSQQTVIPDIGYRPWVRGQSSRISIHWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9114 - protein, 566 aa, Artificial Sequence
  hemagglutinin__InfluenzaA__AFM72197
MKTIIALSYILCMVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPITDSEQTSLYVQASGRVTVSTKRSQQTVIPNIGYRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIKCNICI

SEQ ID NO: 9115 - protein, 566 aa, Artificial Sequence
  hemagglutinin__InfluenzaA__AFM72208
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSINSFFSRLNWLHQLKYRYPALNVTMPNNDKFDKLYIWGVHHPSTDSDQTSLYTQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9116 - protein, 566 aa, Artificial Sequence
  hemagglutinin__InfluenzaA__AFM72219
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSINSFFSRLNWLHQLKYRYPALNVTMPNNDKFDKLYIWGVHHPSTDSDQTSLYTQASGRVTVSTKRSQQTVIPNIGSRPWVRGISSRISIYWTIVKPGDILLIKSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9117 - protein, 565 aa, Artificial Sequence
  hemagglutinin__InfluenzaA__AFM72230
MKAKLLVLLCTFTATYADTICIGYHANNSTDTVDTVLEKNVTVTHSVNLLEDSHNGKLCLLKGIAPLQLGNCSVAGWILGNPECELLISKKSWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9118 - protein, 566 aa, Artificial Sequence
  hemagglutinin__InfluenzaA__AFM72246
MKTIIALSYILCLVFAQKLPGNDNSTATLCLGHHAVSNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISIYAQASGRVTVSTKRSQQTVIPNIGSSPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9119 - protein, 566 aa, Artificial Sequence
  hemagglutinin__InfluenzaA__AFM72257
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLNYKYPALNVTMPNNEKFDKLYIWGVHHPSTDSDQISIYAQASGRVTVSTKRSQQTVIPNIGSRPWVRGVSSGISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9120 - protein, 566 aa, Artificial Sequence
  hemagglutinin__InfluenzaA__AFM72268
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLNYKYPALNVTMPNNEKFDKLYIWGVHHPNTDSDQISIYAQASGRVTVSTKRSQQTVIPNIGSRPWVRGVSSGISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9121 - protein, 566 aa, Artificial Sequence
  hemagglutinin__InfluenzaA__AFM72279
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISIYAQASGRVTVSTKRSQQTVIPNIGSKHWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9122 - protein, 566 aa, Artificial Sequence
  hemagglutinin__InfluenzaA__AFM72290
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKDKYPALNVTMPNNEKFDKLYIWGVHHPSTDSDQISIYAQASGRVTVSTKRSQQTVIPNIGSKHWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9123 - protein, 566 aa, Artificial Sequence
  hemagglutinin__InfluenzaA__AFM72301
MKTIIALSYILCLVFSQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTQLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 9124 - protein, 566 aa, Artificial Sequence
  hemagglutinin__InfluenzaA__AFM72312
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPVTDSDQINLYAQASGRITVSTKRSQQTVIPNIGYRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9125 - protein, 566 aa, Artificial Sequence
  hemagglutinin__InfluenzaA__AFM72323
MKAIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPVTDSDQINLYAQASGRITVSTKRSQQTVIPNIGYRPRVRDNPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9126 - protein, 566 aa, Artificial Sequence
  hemagglutinin__InfluenzaA__AFM72334
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVLHPGTYKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9127 - protein, 566 aa, Artificial Sequence
  hemagglutinin__InfluenzaA__AFM72345
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPVTDSDQISLYTQASGRITVSTKRSQQTVIPNIGFRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9128 - protein, 566 aa, Artificial Sequence
  hemagglutinin__InfluenzaA__AFM72356
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQINLYVQASGRITVSTKRSQQTVIPNIGSRPRVRDVPSRISIYWTIVKPGDILLISSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9129 - protein, 566 aa, Artificial Sequence
  hemagglutinin__InfluenzaA__AFM72367
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPVTDNDQINLYAQASGRITVSTKRSQQTVIPNIGSRPRVRDVPSRISIYWTIVKPGDILLISSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9130 - protein, 566 aa, Artificial Sequence
  hemagglutinin__InfluenzaA__AFM72378
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTQLNFKYPALNVTMPNNEQFDKLYIWGVHHPVTDKDQIFLYAQASGRITVSTKRSQQAVIPNIGYRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9131 - protein, 566 aa, Artificial Sequence
  hemagglutinin__InfluenzaA__AFM72389
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPVTDKDQIFLYAQASGRITVSTKRSQQAVIPNIGYRPRVRNNPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9132 - protein, 566 aa, Artificial Sequence
  hemagglutinin__InfluenzaA__AFM72400
MKTIIALSYILCLVFAQKLPGIDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWAGVTQNGTSSACKRGSNNSFFSRLNWLTHSKFKYPALNVTMPNNEEFDKLYIWGVLHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9133 - protein, 566 aa, Artificial Sequence
  hemagglutinin__InfluenzaA__AFM72411
MKTIIALSYILCLVFAQKLPGIDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWAGVTQNGTSSACKRGSNNSFFSRLNWLTQSKFKYPALNVTMPNNEEFDKLYIWGVHHPVTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDFEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9134 - protein, 566 aa, Artificial Sequence
  hemagglutinin__InfluenzaA__AFM72422
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPVTDNDQIFLYAQASGRITVSTKRSQQTVIPNIGFRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYAEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9135 - protein, 566 aa, Artificial Sequence
  hemagglutinin__InfluenzaA__AFM72433
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPVTDNDQIFLYAQASGRITVSTKRSQQTVIPNIGFRPRVRNNPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYAEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9136 - protein, 566 aa, Artificial Sequence
  hemagglutinin__InfluenzaA__AFM72444
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPVTDNDQILLYAQASGRITVSTKRSQQTVIPNIGFRPRVRNNPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYAEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9137 - protein, 566 aa, Artificial Sequence
  hemagglutinin__InfluenzaA__AFM72455
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTQLKFKYPALNVTMPNNEEFDKLYIWGVHHPVTDNDQIFLYAQASGRITVSTKRSQQTVIPNIGFRPRVRNNPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYAEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9138 - protein, 566 aa, Artificial Sequence
  hemagglutinin__InfluenzaA__AFM72466
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPVTDKDQIFLYAQASGRITVSTKRSQQTVIPNIGFRPRVRNNPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYAEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9139 - protein, 566 aa, Artificial Sequence
  hemagglutinin__InfluenzaA__AFM72488
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTQLKFKYPALNVTMPNNEKFDKLYIWGVHHPVTDNEQIFLYAQASGRITVSTKRSQQTVIPNIGFRPRVRNIPSRISIYWTIVKPGDILLINSTGNLIAPRGYFKIRSGKSSIMRSDAPIGKCNSKCITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9140 - protein, 566 aa, Artificial Sequence
  hemagglutinin__InfluenzaA__AFM72499
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTQLKFKYPALNVTMPNNEKFDKLYIWGVHHPVTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9141 - protein, 565 aa, Artificial Sequence
  hemagglutinin__InfluenzaA__AFM72521
MKVKLLVLLCTFTATYADTICIGYHANNSTDTVDTVLEKNVTVTHSVNLLENSHNGRLCLLKGIAPLQLGNCSVAGWILGNPECELLISKESWSYIVEKPNPENGTCYPGHFADYEELREQLSSVSSLERFEIFPKESSWPNHTVTGVSASCSHNGESSFYRNLLWLTGKNGLYPNLSKSYANNKEKEVLVLWGVHHPPNIGNQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 9142 - protein, 565 aa, Artificial Sequence; identical to SEQ ID NO: 9141
  hemagglutinin__InfluenzaA__AFM72532

SEQ ID NO: 9143 - protein, 565 aa, Artificial Sequence; identical to SEQ ID NO: 9141
  hemagglutinin__InfluenzaA__AFM72543

SEQ ID NO: 9144 - protein, 565 aa, Artificial Sequence
  hemagglutinin__InfluenzaA__AFM72554
MKVKLLVLLCTFTATYADTICIGYHANNSTDTVDTVLEKNVTVTHSVNLLENSHNGRLCLLKGIAPLQLGNCSVAGWILGNPECELLISKESWSYIVEKPNPENGTCYPGHFADYEELREQLSSVSSLERFEIFPKESSWPNHTVTGVSASCSHNGESSFYRNLLWLTGKNGLYPNLSKSYANNKEKEVLVLWGVHHPPNIGNQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDEVKLESMGVYQILAIYSTVASSLVLLVSLGAISFWMCSNGSLQCRICI

SEQ ID NO: 9145 - protein, 566 aa, Artificial Sequence
  hemagglutinin__InfluenzaA__AFM72565
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSSCIRRSNNSFFSRLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9146 - protein, 566 aa, Artificial Sequence
  hemagglutinin__InfluenzaA__AFM72576
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSSCIRGSNNSFFSRLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9147 - protein, 565 aa, Artificial Sequence
  hemagglutinin__InfluenzaA__AFM72799
MKVKLLVLLCTFTATYADTICIGYHANNSTDTVDTVLEKNVTVTHSVNLLEDNHNGKLCLLKGKAPLQLGNCSVAGWILGNPECGLLISKESWSYIVERPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGNQMTLYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 9148 - protein, 565 aa, Artificial Sequence; identical to SEQ ID NO: 9147
  hemagglutinin__InfluenzaA__AFM72810

SEQ ID NO: 9149 - protein, 565 aa, Artificial Sequence; identical to SEQ ID NO: 9147
  hemagglutinin__InfluenzaA__AFM72821

SEQ ID NO: 9150 - protein, 566 aa, Artificial Sequence
  hemagglutinin__InfluenzaA__AFM72852
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9151 - protein, 566 aa, Artificial Sequence
  hemagglutinin__InfluenzaA__AFM72862
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSNSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9152 - protein, 566 aa, Artificial Sequence
  hemagglutinin__InfluenzaA__AFM72872
MKTIIALSYTLCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFPYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9153 - protein, 566 aa, Artificial Sequence
  hemagglutinin__InfluenzaA__AFM72883
MKTIIALSYILCLVFAQKLPGNDNSTATLCLGHHAVPNGTIVKTITNDQIEVTNATELVQNSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPVTDKDQIFLYAQASGRITVSTKRSQQTVIPNIGSRPRVRNIPTRISIYWTIVKPGDILLINSTGNLIAPRGYFKMQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9154 - protein, 566 aa, Artificial Sequence
  hemagglutinin__InfluenzaA__AFM72894
MKTIIALSYILCLVFAQKLPGNDNSTATLCLGHHAVPNGTIVKTITNDQIEVTNATELVQNSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTQLNFKYPALNVTMPNNEQFDKLYIWGVHHPVTDKDQIFLYAQASGRITVSTKRSQQTVIPNIGSRPRVRNIPSRISIYWTIVKPGDILLINSTGNLIAPRGYFKMQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9155 - protein, 566 aa, Artificial Sequence
  hemagglutinin__InfluenzaA__AFM72916
MKTIIALSYILCLVFAQKIPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFPYAQASGRITVSTKRSQQTAIPNIGSRPRVRNIPSRISIYWTIVKPGDILLINSTGNLIAPRGYFKIRSGKSSIMRSDAPIGKCNSGCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWFLWISFAISCFLLCVALLGFIMWACQKGNIRCNICI

SEQ ID NO: 9156 - protein, 566 aa, Artificial Sequence
  hemagglutinin__InfluenzaA__AFM72927
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQTSLYAQASGRITVSTKRSQQTVIPNIGSRPRVRNIPSRISIYWTIVKPGDILLINSIGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9157 - protein, 566 aa, Artificial Sequence
  hemagglutinin__InfluenzaA__AFM72938
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQTSLYAQASGRITVSTKRSQQTVIPNIGSRPRVRNNPSRISIYWTIVKPGDILLINSIGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9158 - protein, 566 aa, Artificial Sequence
  hemagglutinin__InfluenzaA__AFM72949
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTQLKFKYPALNVTMPNNEQFDKLYIWGVHHPGTDNDQTSLYAQASGRITVSTKRSQQTVIPNIGSRPRVRNNPSRISIYWTIVKPGDILLINSIGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9159 - protein, 566 aa, Artificial Sequence
  hemagglutinin__InfluenzaA__AFM72960
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFKWTGVTQNGTSSACIRRSNNSFFSRLNWLTHLKFKYPALNVTMPNNEQFDKLYIWGVHHPGTDNDQTSLYAQASGRITVSTKRSQQTVIPNIGSRPRVRNIPSRISIYWTIVKPGDILLINSIGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9160 - protein, 566 aa, Artificial Sequence
  hemagglutinin__InfluenzaA__AFM72971
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFKWTGVTQNGTSSACIRRSNNSFFSRLNWLTQLNFKYPALNVTMPNNEQFDKLYIWGVHHPGTDNDQTSLYAQASGRITVSTKRSQQTVIPNIGSRPRVRNIPSRISIYWTIVKPGDILLINSIGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9161 - protein, 566 aa, Artificial Sequence
  hemagglutinin__InfluenzaA__AFM72982
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNSESFNWTGVTQNGTSSACIRRSNNSFFSRLNWLTHLNFKYPALNVTMPNNEQFDKLYIWGVHHPGTDKDQIFPYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYIKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISLAISCFLLCVALLGFIMWACQKGNIRCNICI

SEQ ID NO: 9162 - protein, 566 aa, Artificial Sequence
  hemagglutinin__InfluenzaA__AFM72993
MKTIIALSYILCLVFAQKLPGNDNSTATLCLGHHAVPNGTIVKTITNDQIEVTNATELVQSSSAGEICDSPHQILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVLHPGTYKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9163 - protein, 566 aa, Artificial Sequence
  hemagglutinin__InfluenzaA__AFM73004
MKTIIALSYILCLVFAQKLPGNDNSTATLCLGHHAVPNGTIVKTITNDQIEVTNATELVQSSSAGEICDSPHQILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVLHPGTYKDQIFLYAQASGRVTVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFFLCVALLGFIMWACQKGNIRCNICI

SEQ ID NO: 9164 - protein, 566 aa, Artificial Sequence
  hemagglutinin__InfluenzaA__AFM73015
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9165 - protein, 566 aa, Artificial Sequence
  hemagglutinin__InfluenzaA__AFM73025
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTDDQQSLYQNADTYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9166 - protein, 566 aa, Artificial Sequence; identical to SEQ ID NO: 9165
  hemagglutinin__InfluenzaA__AFM73035

SEQ ID NO: 9167 - protein, 566 aa, Artificial Sequence
  hemagglutinin__InfluenzaA__AFM73045
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHESNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9168 - protein, 566 aa, Artificial Sequence
  hemagglutinin__InfluenzaA__AFM73055
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVEKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9169 - protein, 566 aa, Artificial Sequence
  hemagglutinin__InfluenzaA__AFM73065
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKEGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9170 - protein, 566 aa, Artificial Sequence; identical to SEQ ID NO: 915
  hemagglutinin__InfluenzaA__AFM73477

SEQ ID NO: 9171 - protein, 568 aa, Artificial Sequence
  hemagglutinin__InfluenzaA__AFM78567
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 9172 - protein, 566 aa, Artificial Sequence
  hemagglutinin__InfluenzaA__AFM78646
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQGLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9173 - protein, 565 aa, Artificial Sequence
  hemagglutinin__InfluenzaA__AFM85179
MKVKLLILLCTFTATYADTICIGYHANNSTDTVDTVLEKNVTVTHSVNLLENSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLILWGVHHPPNIGDQRTLYYTENAYVSVVSSHYSRRFTPEITKRPKVRDQEGRINYYWTLLEPGDTIIFEANGNLIAPWYAFALSRGFGSGIIISNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKFERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9174 - protein, 566 aa, Artificial Sequence
  hemagglutinin__InfluenzaA__AFN11846
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9175 - protein, 566 aa, Artificial Sequence; identical to SEQ ID NO: 3530
  hemagglutinin__InfluenzaA__AFN17371

SEQ ID NO: 9176 - protein, 566 aa, Artificial Sequence; identical to SEQ ID NO: 2669
  hemagglutinin__InfluenzaA__AFN17381

SEQ ID NO: 9177 - protein, 566 aa, Artificial Sequence; identical to SEQ ID NO: 2669
  hemagglutinin__InfluenzaA__AFN17391

SEQ ID NO: 9178 - protein, 566 aa, Artificial Sequence; identical to SEQ ID NO: 2669
  hemagglutinin__InfluenzaA__AFN17401

SEQ ID NO: 9179 - protein, 566 aa, Artificial Sequence; identical to SEQ ID NO: 2669
  hemagglutinin__InfluenzaA__AFN17411

SEQ ID NO: 9180 - protein, 566 aa, Artificial Sequence; identical to SEQ ID NO: 2669
  hemagglutinin__InfluenzaA__AFN17421

SEQ ID NO: 9181 - protein, 566 aa, Artificial Sequence; identical to SEQ ID NO: 2760
  hemagglutinin__InfluenzaA__AFN17431

SEQ ID NO: 9182 - protein, 566 aa, Artificial Sequence
  hemagglutinin__InfluenzaA__AFN17441
MKAILVVLLYTFATANADTLCIGYHANNSTDTVDTVLEKNVTVTHSVNLLEDKHNGKLCKLRGVAPLHLGKCNIAGWILGNPECESLSKASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9183 - protein, 566 aa, Artificial Sequence; identical to SEQ ID NO: 5224
  hemagglutinin__InfluenzaA__AFN17451

SEQ ID NO: 9184 - protein, 566 aa, Artificial Sequence; identical to SEQ ID NO: 3511
  hemagglutinin__InfluenzaA__AFN17467

SEQ ID NO: 9185 - protein, 566 aa, Artificial Sequence; identical to SEQ ID NO: 2669
  hemagglutinin__InfluenzaA__AFN17477

SEQ ID NO: 9186 - protein, 566 aa, Artificial Sequence; identical to SEQ ID NO: 3530
  hemagglutinin__InfluenzaA__AFN17487

SEQ ID NO: 9187 - protein, 566 aa, Artificial Sequence; identical to SEQ ID NO: 2669
  hemagglutinin__InfluenzaA__AFN17497

SEQ ID NO: 9188 - protein, 566 aa, Artificial Sequence; identical to SEQ ID NO: 2669
  hemagglutinin__InfluenzaA__AFN17507

SEQ ID NO: 9189 - protein, 566 aa, Artificial Sequence; identical to SEQ ID NO: 3511
  hemagglutinin__InfluenzaA__AFN17517

SEQ ID NO: 9190 - protein, 566 aa, Artificial Sequence; identical to SEQ ID NO: 3530
  hemagglutinin__InfluenzaA__AFN17527

SEQ ID NO: 9191 - protein, 566 aa, Artificial Sequence; identical to SEQ ID NO: 2669
  hemagglutinin__InfluenzaA__AFN17537

SEQ ID NO: 9192 - protein, 566 aa, Artificial Sequence; identical to SEQ ID NO: 2911
  hemagglutinin__InfluenzaA__AFN17547

SEQ ID NO: 9193 - protein, 566 aa, Artificial Sequence; identical to SEQ ID NO: 4200
  hemagglutinin__InfluenzaA__AFN17557

SEQ ID NO: 9194 - protein, 566 aa, Artificial Sequence; identical to SEQ ID NO: 3511
  hemagglutinin__InfluenzaA__AFN17567

SEQ ID NO: 9195 - protein, 566 aa, Artificial Sequence; identical to SEQ ID NO: 2911
  hemagglutinin__InfluenzaA__AFN17574

SEQ ID NO: 9196 - protein, 566 aa, Artificial Sequence; identical to SEQ ID NO: 2669
  hemagglutinin__InfluenzaA__AFN17580

SEQ ID NO: 9197 - protein, 566 aa, Artificial Sequence; identical to SEQ ID NO: 2669
  hemagglutinin__InfluenzaA__AFN17586

SEQ ID NO: 9198 - protein, 566 aa, Artificial Sequence; identical to SEQ ID NO: 3530
  hemagglutinin__InfluenzaA__AFN17595

SEQ ID NO: 9199 - protein, 566 aa, Artificial Sequence; identical to SEQ ID NO: 2669
  hemagglutinin__InfluenzaA__AFN17605

SEQ ID NO: 9200 - protein, 566 aa, Artificial Sequence; identical to SEQ ID NO: 2669
  hemagglutinin__InfluenzaA__AFN17615

SEQ ID NO: 9201 - protein, 566 aa, Artificial Sequence; identical to SEQ ID NO: 2669
  hemagglutinin__InfluenzaA__AFN17625

SEQ ID NO: 9202 - protein, 566 aa, Artificial Sequence; identical to SEQ ID NO: 2669
  hemagglutinin__InfluenzaA__AFN17635

SEQ ID NO: 9203 - protein, 566 aa, Artificial Sequence
  hemagglutinin__InfluenzaA__AFN17645
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERVEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9204 - protein, 566 aa, Artificial Sequence; identical to SEQ ID NO: 3530
  hemagglutinin__InfluenzaA__AFN17655

SEQ ID NO: 9205 - protein, 566 aa, Artificial Sequence; identical to SEQ ID NO: 3530
  hemagglutinin__InfluenzaA__AFN17665

SEQ ID NO: 9206 - protein, 566 aa, Artificial Sequence
  hemagglutinin__InfluenzaA__AFN17675
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSESYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9207 - protein, 566 aa, Artificial Sequence
  hemagglutinin__InfluenzaA__AFN17685
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPRDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9208 - protein, 566 aa, Artificial Sequence; identical to SEQ ID NO: 2669
  hemagglutinin__InfluenzaA__AFN17695

SEQ ID NO: 9209 - protein, 566 aa, Artificial Sequence; identical to SEQ ID NO: 2669
  hemagglutinin__InfluenzaA__AFN17705

SEQ ID NO: 9210 - protein, 566 aa, Artificial Sequence; identical to SEQ ID NO: 3298
  hemagglutinin__InfluenzaA__AFN17715

SEQ ID NO: 9211 - protein, 566 aa, Artificial Sequence
  hemagglutinin__InfluenzaA__AFN17725
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPQVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9212 - protein, 566 aa, Artificial Sequence; identical to SEQ ID NO: 2669
  hemagglutinin__InfluenzaA__AFN17735

SEQ ID NO: 9213 - protein, 566 aa, Artificial Sequence; identical to SEQ ID NO: 2669
  hemagglutinin__InfluenzaA__AFN17742

SEQ ID NO: 9214 - protein, 566 aa, Artificial Sequence; identical to SEQ ID NO: 2669
  hemagglutinin__InfluenzaA__AFN17748

SEQ ID NO: 9215 - protein, 566 aa, Artificial Sequence; identical to SEQ ID NO: 2669
  hemagglutinin__InfluenzaA__AFN17757

SEQ ID NO: 9216 - protein, 566 aa, Artificial Sequence; identical to SEQ ID NO: 3298
  hemagglutinin__InfluenzaA__AFN17767

SEQ ID NO: 9217 - protein, 566 aa, Artificial Sequence; identical to SEQ ID NO: 7679
  hemagglutinin__InfluenzaA__AFN17774

SEQ ID NO: 9218 - protein, 566 aa, Artificial Sequence; identical to SEQ ID NO: 2669
  hemagglutinin__InfluenzaA__AFN17783

SEQ ID NO: 9219 - protein, 566 aa, Artificial Sequence; identical to SEQ ID NO: 3298
  hemagglutinin__InfluenzaA__AFN17793

SEQ ID NO: 9220 - protein, 566 aa, Artificial Sequence; identical to SEQ ID NO: 2669
  hemagglutinin__InfluenzaA__AFN17803

SEQ ID NO: 9221 - protein, 566 aa, Artificial Sequence; identical to SEQ ID NO: 2669
  hemagglutinin__InfluenzaA__AFN17813

SEQ ID NO: 9222 - protein, 566 aa, Artificial Sequence
  hemagglutinin__InfluenzaA__AFN17823
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSESYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9223 - protein, 566 aa, Artificial Sequence
  hemagglutinin__InfluenzaA__AFN17833
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPNAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9224 - protein, 566 aa, Artificial Sequence; identical to SEQ ID NO: 7178
  hemagglutinin__InfluenzaA__AFN17843

SEQ ID NO: 9225 - protein, 566 aa, Artificial Sequence; identical to SEQ ID NO: 2669
  hemagglutinin__InfluenzaA__AFN17853

SEQ ID NO: 9226 - protein, 566 aa, Artificial Sequence; identical to SEQ ID NO: 2911
  hemagglutinin__InfluenzaA__AFN17863

SEQ ID NO: 9227 - protein, 566 aa, Artificial Sequence
  hemagglutinin__InfluenzaA__AFN17873
MKAILVVLLYTFATANADTLCIGYHANNSTDTVDTVLEKNVTVTHSVNLLEDKHNGKLCKLRGVAPLHLGKCNIAGWILGNPECESLSTAGSWSYIVETSSSDNGTCYPGDFIDYEELREQLSSVSSFERFEIFPKTSSWPNHDLNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9228 - protein, 566 aa, Artificial Sequence
  hemagglutinin__InfluenzaA__AFN17883
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTLKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9229 - protein, 566 aa, Artificial Sequence; identical to SEQ ID NO: 2669
  hemagglutinin__InfluenzaA__AFN17893

SEQ ID NO: 9230 - protein, 566 aa, Artificial Sequence
  hemagglutinin__InfluenzaA__AFN17903
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHESNKGVTAACPHAGAKSFYKNLIWLVKKGNSYPKLSKSYVNDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9231 - protein, 566 aa, Artificial Sequence; identical to SEQ ID NO: 3022
  hemagglutinin__InfluenzaA__AFN17919

SEQ ID NO: 9232 - protein, 566 aa, Artificial Sequence; identical to SEQ ID NO: 2911
  hemagglutinin__InfluenzaA__AFN17929

SEQ ID NO: 9233 - protein, 566 aa, Artificial Sequence; identical to SEQ ID NO: 8927
  hemagglutinin__InfluenzaA__AFN17939

SEQ ID NO: 9234 - protein, 566 aa, Artificial Sequence; identical to SEQ ID NO: 3530
  hemagglutinin__InfluenzaA__AFN17949

SEQ ID NO: 9235 - protein, 566 aa, Artificial Sequence
  hemagglutinin__InfluenzaA__AFN17959
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYVNDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9236 - protein, 566 aa, Artificial Sequence; identical to SEQ ID NO: 4351
  hemagglutinin__InfluenzaA__AFN17969

SEQ ID NO: 9237 - protein, 566 aa, Artificial Sequence; identical to SEQ ID NO: 3530
  hemagglutinin__InfluenzaA__AFN17979

SEQ ID NO: 9238 - protein, 566 aa, Artificial Sequence
  hemagglutinin__InfluenzaA__AFN17989
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIGKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9239 - protein, 566 aa, Artificial Sequence; identical to SEQ ID NO: 2669
  hemagglutinin__InfluenzaA__AFN17999

SEQ ID NO: 9240 - protein, 566 aa, Artificial Sequence
  hemagglutinin__InfluenzaA__AFN18019
MKAILVVLLYTFATAKADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9241 - protein, 566 aa, Artificial Sequence; identical to SEQ ID NO: 3530
  hemagglutinin__InfluenzaA__AFN18039

SEQ ID NO: 9242 - protein, 566 aa, Artificial Sequence; identical to SEQ ID NO: 2669
  hemagglutinin__InfluenzaA__AFN18049

SEQ ID NO: 9243 - protein, 566 aa, Artificial Sequence
  hemagglutinin__InfluenzaA__AFN18059
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNACMESVKNGTYDYPKYSEEAKLNREEIDGVKLESTRIYQILAIYSTVASSLVLVVSLGAISFWMCSNGSLQCRICI

SEQ ID NO: 9244 - protein, 566 aa, Artificial Sequence; identical to SEQ ID NO: 2669
  hemagglutinin__InfluenzaA__AFN18078

SEQ ID NO: 9245 - protein, 566 aa, Artificial Sequence
  hemagglutinin__InfluenzaA__AFN18088
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9246 - protein, 566 aa, Artificial Sequence
  hemagglutinin__InfluenzaA__AFN18098
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGNFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAVERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9247 - protein, 566 aa, Artificial Sequence
  hemagglutinin__InfluenzaA__AFN18105
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTNCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9248 - protein, 566 aa, Artificial Sequence; identical to SEQ ID NO: 2911
  hemagglutinin__InfluenzaA__AFN18107

SEQ ID NO: 9249 - protein, 566 aa, Artificial Sequence; identical to SEQ ID NO: 9243
  hemagglutinin__InfluenzaA__AFN18117

SEQ ID NO: 9250 - protein, 566 aa, Artificial Sequence; identical to SEQ ID NO: 2669
  hemagglutinin__InfluenzaA__AFN18119

SEQ ID NO: 9251 - protein, 566 aa, Artificial Sequence
  hemagglutinin__InfluenzaA__AFN18121
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGARSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9252 - protein, 566 aa, Artificial Sequence; identical to SEQ ID NO: 9243
  hemagglutinin__InfluenzaA__AFN18133

SEQ ID NO: 9253 - protein, 566 aa, Artificial Sequence; identical to SEQ ID NO: 8927
  hemagglutinin__InfluenzaA__AFN18135

SEQ ID NO: 9254 - protein, 566 aa, Artificial Sequence; identical to SEQ ID NO: 3511
  hemagglutinin__InfluenzaA__AFN18137

SEQ ID NO: 9255 - protein, 566 aa, Artificial Sequence
  hemagglutinin__InfluenzaA__AFN18139
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQGLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9256 - protein, 566 aa, Artificial Sequence; identical to SEQ ID NO: 9251
  hemagglutinin__InfluenzaA__AFN18141

SEQ ID NO: 9257 - protein, 566 aa, Artificial Sequence; identical to SEQ ID NO: 3530
  hemagglutinin__InfluenzaA__AFN18148

SEQ ID NO: 9258 - protein, 566 aa, Artificial Sequence; identical to SEQ ID NO: 3833
  hemagglutinin__InfluenzaA__AFN18155

SEQ ID NO: 9259 - protein, 566 aa, Artificial Sequence
  hemagglutinin__InfluenzaA__AFN18157
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9260 - protein, 566 aa, Artificial Sequence
  hemagglutinin__InfluenzaA__AFN18159
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGSKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9261 - protein, 566 aa, Artificial Sequence
  hemagglutinin__InfluenzaA__AFN18164
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLIVPRYAFAMERNAGSGIIISNTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKELNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAVYSTVASSLVLVVSLGAISFWMCSNGSLQCRICI

SEQ ID NO: 9262 - protein, 566 aa, Artificial Sequence
  hemagglutinin__InfluenzaA__AFN18171
MKAILVVLLYTFATANADTLCIGYHANNSTDTVDTVLEKNVTVTHSVNLLEDKHSGKLCKLRGVAPLHLGKCNIAGWILGNPECESLSTASSWSYIVETSSSDNGKCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVKDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9263 - protein, 566 aa, Artificial Sequence
  hemagglutinin__InfluenzaA__AFN18176
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9264 - protein, 566 aa, Artificial Sequence
  hemagglutinin__InfluenzaA__AFN18183
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLMVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9265 - protein, 566 aa, Artificial Sequence; identical to SEQ ID NO: 4221
  hemagglutinin__InfluenzaA__AFN18195

SEQ ID NO: 9266 - protein, 566 aa, Artificial Sequence; identical to SEQ ID NO: 2669
  hemagglutinin__InfluenzaA__AFN18200

SEQ ID NO: 9267 - protein, 566 aa, Artificial Sequence
  hemagglutinin__InfluenzaA__AFN18207
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKSLIWLVKKGNSYPKLSKSYINDKGREVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9268 - protein, 566 aa, Artificial Sequence
  hemagglutinin__InfluenzaA__AFN18214
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 9269 - protein, 566 aa, Artificial Sequence; identical to SEQ ID NO: 5224
  hemagglutinin__InfluenzaA__AFN18224

SEQ ID NO: 9270 - protein, 566 aa, Artificial Sequence; identical to SEQ ID NO: 4221
  hemagglutinin__InfluenzaA__AFN18231

SEQ ID NO: 9271 - protein, 566 aa, Artificial Sequence
  hemagglutinin__InfluenzaA__AFN18233
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSRKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9272 - protein, 566 aa, Artificial Sequence
  hemagglutinin__InfluenzaA__AFN18243
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9273 - protein, 566 aa, Artificial Sequence; identical to SEQ ID NO: 8758
  hemagglutinin__InfluenzaA__AFN18245

SEQ ID NO: 9274 - protein, 566 aa, Artificial Sequence; identical to SEQ ID NO: 5224
  hemagglutinin__InfluenzaA__AFN18255

SEQ ID NO: 9275 - protein, 566 aa, Artificial Sequence; identical to SEQ ID NO: 9272
  hemagglutinin__InfluenzaA__AFN18260

SEQ ID NO: 9276 - protein, 566 aa, Artificial Sequence; identical to SEQ ID NO: 9272
  hemagglutinin__InfluenzaA__AFN18267

SEQ ID NO: 9277 - protein, 566 aa, Artificial Sequence
  hemagglutinin__InfluenzaA__AFN18269
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFEKFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9278 - protein, 566 aa, Artificial Sequence; identical to SEQ ID NO: 3833
  hemagglutinin__InfluenzaA__AFN18271

SEQ ID NO: 9279 - protein, 566 aa, Artificial Sequence; identical to SEQ ID NO: 4221
  hemagglutinin__InfluenzaA__AFN18273

SEQ ID NO: 9280 - protein, 566 aa, Artificial Sequence; identical to SEQ ID NO: 3833
  hemagglutinin__InfluenzaA__AFN18280

SEQ ID NO: 9281 - protein, 566 aa, Artificial Sequence; identical to SEQ ID NO: 3467
  hemagglutinin__InfluenzaA__AFN18303

SEQ ID NO: 9282 - protein, 566 aa, Artificial Sequence
  hemagglutinin__InfluenzaA__AFN18305
MKAILVVLLYTFATANADTLCIGYHANNSTDTVDTVLEKNVTVTHSANLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLGKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9283 - protein, 566 aa, Artificial Sequence
  hemagglutinin__InfluenzaA__AFN18307
MKAILVVLLYTFAAANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNTGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9284 - protein, 566 aa, Artificial Sequence
  hemagglutinin__InfluenzaA__AFN18312
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGITAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVISLGAISFWMCSNGSLQCRICI

SEQ ID NO: 9285 - protein, 566 aa, Artificial Sequence; identical to SEQ ID NO: 5034
  hemagglutinin__InfluenzaA__AFN18319

SEQ ID NO: 9286 - protein, 566 aa, Artificial Sequence; identical to SEQ ID NO: 7131
  hemagglutinin__InfluenzaA__AFN18324

SEQ ID NO: 9287 - protein, 566 aa, Artificial Sequence; identical to SEQ ID NO: 3022
  hemagglutinin__InfluenzaA__AFN18334

SEQ ID NO: 9288 - protein, 566 aa, Artificial Sequence; identical to SEQ ID NO: 4785
  hemagglutinin__InfluenzaA__AFN18344

SEQ ID NO: 9289 - protein, 566 aa, Artificial Sequence; identical to SEQ ID NO: 2669
  hemagglutinin__InfluenzaA__AFN18354

SEQ ID NO: 9290 - protein, 566 aa, Artificial Sequence
  hemagglutinin__InfluenzaA__AFN18364
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDLNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9291 - protein, 566 aa, Artificial Sequence; identical to SEQ ID NO: 2669
  hemagglutinin__InfluenzaA__AFN18374

SEQ ID NO: 9292 - protein, 566 aa, Artificial Sequence
  hemagglutinin__InfluenzaA__AFN18381
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVKPGDKITFEATGNLVVPRYAFAMERNAGSGIIISDTPVQDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9293 - protein, 566 aa, Artificial Sequence
  hemagglutinin__InfluenzaA__AFN18390
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKIRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9294 - protein, 566 aa, Artificial Sequence
  hemagglutinin__InfluenzaA__AFN18400
MKAILVVLLYTFATANADTLCIGYHANNSTDTVDTVLEKNVTVTHSVNLLEDKHNGKLCKLRGVTPLHLGKCNIAGWILGNPECESLSKASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNVGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9295 - protein, 566 aa, Artificial Sequence; identical to SEQ ID NO: 2760
  hemagglutinin__InfluenzaA__AFN18410

SEQ ID NO: 9296 - protein, 566 aa, Artificial Sequence; identical to SEQ ID NO: 2669
  hemagglutinin__InfluenzaA__AFN18420

SEQ ID NO: 9297 - protein, 566 aa, Artificial Sequence
  hemagglutinin__InfluenzaA__AFN18430
MKAILVVLLYTFATANADTLCIGYHANNSTDTVDTVLEKNVTVTHSVNLLENKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9298 - protein, 566 aa, Artificial Sequence; identical to SEQ ID NO: 2669
  hemagglutinin__InfluenzaA__AFN18440

SEQ ID NO: 9299 - protein, 566 aa, Artificial Sequence; identical to SEQ ID NO: 2669
  hemagglutinin__InfluenzaA__AFN18450

SEQ ID NO: 9300 - protein, 566 aa, Artificial Sequence; identical to SEQ ID NO: 5224
  hemagglutinin__InfluenzaA__AFN18460

SEQ ID NO: 9301 - protein, 566 aa, Artificial Sequence; identical to SEQ ID NO: 3530
  hemagglutinin__InfluenzaA__AFN18470

SEQ ID NO: 9302 - protein, 566 aa, Artificial Sequence; identical to SEQ ID NO: 2760
  hemagglutinin__InfluenzaA__AFN18480

SEQ ID NO: 9303 - protein, 566 aa, Artificial Sequence; identical to SEQ ID NO: 3530
  hemagglutinin__InfluenzaA__AFN18490

SEQ ID NO: 9304 - protein, 566 aa, Artificial Sequence; identical to SEQ ID NO: 2669
  hemagglutinin__InfluenzaA__AFN18497

SEQ ID NO: 9305 - protein, 566 aa, Artificial Sequence; identical to SEQ ID NO: 2669
  hemagglutinin__InfluenzaA__AFN18512

SEQ ID NO: 9306 - protein, 566 aa, Artificial Sequence
  hemagglutinin__InfluenzaA__AFN18519
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKENSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9307 - protein, 566 aa, Artificial Sequence
  hemagglutinin__InfluenzaA__AFN18521
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSGEAKLNREEIDGVKLESTRIYQILAIYSTVASSLVLVVSLGAISFWMCSNGSLQCRICI

SEQ ID NO: 9308 - protein, 566 aa, Artificial Sequence; identical to SEQ ID NO: 2669
  hemagglutinin__InfluenzaA__AFN18528

SEQ ID NO: 9309 - protein, 566 aa, Artificial Sequence; identical to SEQ ID NO: 2669
  hemagglutinin__InfluenzaA__AFN18531

SEQ ID NO: 9310 - protein, 566 aa, Artificial Sequence; identical to SEQ ID NO: 5266
  hemagglutinin__InfluenzaA__AFN18543

SEQ ID NO: 9311 - protein, 566 aa, Artificial Sequence; identical to SEQ ID NO: 7551
  hemagglutinin__InfluenzaA__AFN18545

SEQ ID NO: 9312 - protein, 566 aa, Artificial Sequence; identical to SEQ ID NO: 3530
  hemagglutinin__InfluenzaA__AFN18550

SEQ ID NO: 9313 - protein, 566 aa, Artificial Sequence
  hemagglutinin__InfluenzaA__AFN18557
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9314 - protein, 566 aa, Artificial Sequence
  hemagglutinin__InfluenzaA__AFN18559
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQNLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9315 - protein, 566 aa, Artificial Sequence; identical to SEQ ID NO: 3535
  hemagglutinin__InfluenzaA__AFN18561

SEQ ID NO: 9316 - protein, 566 aa, Artificial Sequence; identical to SEQ ID NO: 3771
  hemagglutinin__InfluenzaA__AFN18563

SEQ ID NO: 9317 - protein, 566 aa, Artificial Sequence
  hemagglutinin__InfluenzaA__AFN18565
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRMENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9318 - protein, 566 aa, Artificial Sequence
  hemagglutinin__InfluenzaA__AFN18570
MKAILVVLLYTFATANADTLCIGYHANNSTDTVDTVLEKNVTVTHSVNLLEDKHNGKLCKLRGVAPLHLGKCNIAGWILGNPECESLSTVSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9319 - protein, 566 aa, Artificial Sequence; identical to SEQ ID NO: 2669
  hemagglutinin__InfluenzaA__AFN18580

SEQ ID NO: 9320 - protein, 566 aa, Artificial Sequence; identical to SEQ ID NO: 2911
  hemagglutinin__InfluenzaA__AFN18590

SEQ ID NO: 9321 - protein, 566 aa, Artificial Sequence
  hemagglutinin__InfluenzaA__AFN18600
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQNLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNACMESVKNGTYDYPKYSEEAKLNREEIDGVKLESTRIYQILAIYSTVASSLVLVVSLGAISFWMCSNGSLQCRICI

SEQ ID NO: 9322 - protein, 566 aa, Artificial Sequence; identical to SEQ ID NO: 2669
  hemagglutinin__InfluenzaA__AFN18610

SEQ ID NO: 9323 - protein, 566 aa, Artificial Sequence
  hemagglutinin__InfluenzaA__AFN18617
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQSAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLKREEIDGVKLESTRIYQILAIYSTVASSLVLVVSLGAISFWMCSNGSLQCRICI

SEQ ID NO: 9324 - protein, 566 aa, Artificial Sequence; identical to SEQ ID NO: 3530
  hemagglutinin__InfluenzaA__AFN18622

SEQ ID NO: 9325 - protein, 566 aa, Artificial Sequence; identical to SEQ ID NO: 2669
  hemagglutinin__InfluenzaA__AFN18629

SEQ ID NO: 9326 - protein, 566 aa, Artificial Sequence; identical to SEQ ID NO: 2911
  hemagglutinin__InfluenzaA__AFN18634

SEQ ID NO: 9327 - protein, 566 aa, Artificial Sequence
  hemagglutinin__InfluenzaA__AFN18644
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQSAIDEITNKVNSVIEKVNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9328 - protein, 566 aa, Artificial Sequence; identical to SEQ ID NO: 3530
  hemagglutinin__InfluenzaA__AFN18654

SEQ ID NO: 9329 - protein, 566 aa, Artificial Sequence; identical to SEQ ID NO: 2669
  hemagglutinin__InfluenzaA__AFN18664

SEQ ID NO: 9330 - protein, 566 aa, Artificial Sequence; identical to SEQ ID NO: 2911
  hemagglutinin__InfluenzaA__AFN18674

SEQ ID NO: 9331 - protein, 566 aa, Artificial Sequence; identical to SEQ ID NO: 2669
  hemagglutinin__InfluenzaA__AFN18684

SEQ ID NO: 9332 - protein, 566 aa, Artificial Sequence; identical to SEQ ID NO: 3530
  hemagglutinin__InfluenzaA__AFN18694

SEQ ID NO: 9333 - protein, 566 aa, Artificial Sequence
  hemagglutinin__InfluenzaA__AFN18704
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQSAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9334 - protein, 566 aa, Artificial Sequence; identical to SEQ ID NO: 4903
  hemagglutinin__InfluenzaA__AFN18714

SEQ ID NO: 9335 - protein, 566 aa, Artificial Sequence; identical to SEQ ID NO: 2669
  hemagglutinin__InfluenzaA__AFN18721

SEQ ID NO: 9336 - protein, 566 aa, Artificial Sequence; identical to SEQ ID NO: 5335
  hemagglutinin__InfluenzaA__AFN18725

SEQ ID NO: 9337 - protein, 566 aa, Artificial Sequence
  hemagglutinin__InfluenzaA__AFN18735
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKTLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9338 - protein, 566 aa, Artificial Sequence; identical to SEQ ID NO: 2669
  hemagglutinin__InfluenzaA__AFN18742

SEQ ID NO: 9339 - protein, 566 aa, Artificial Sequence; identical to SEQ ID NO: 3771
  hemagglutinin__InfluenzaA__AFN18747

SEQ ID NO: 9340 - protein, 566 aa, Artificial Sequence
  hemagglutinin__InfluenzaA__AFN18757
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLAVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9341 - protein, 566 aa, Artificial Sequence; identical to SEQ ID NO: 2669
  hemagglutinin__InfluenzaA__AFN18767

SEQ ID NO: 9342 - protein, 566 aa, Artificial Sequence; identical to SEQ ID NO: 9333
  hemagglutinin__InfluenzaA__AFN18774

SEQ ID NO: 9343 - protein, 566 aa, Artificial Sequence; identical to SEQ ID NO: 2669
  hemagglutinin__InfluenzaA__AFN18776

SEQ ID NO: 9344 - protein, 566 aa, Artificial Sequence; identical to SEQ ID NO: 3535
  hemagglutinin__InfluenzaA__AFN18778

SEQ ID NO: 9345 - protein, 566 aa, Artificial Sequence; identical to SEQ ID NO: 2669
  hemagglutinin__InfluenzaA__AFN18784

SEQ ID NO: 9346 - protein, 566 aa, Artificial Sequence; identical to SEQ ID NO: 3535
  hemagglutinin__InfluenzaA__AFN18789

SEQ ID NO: 9347 - protein, 566 aa, Artificial Sequence; identical to SEQ ID NO: 2669
  hemagglutinin__InfluenzaA__AFN18799

SEQ ID NO: 9348 - protein, 566 aa, Artificial Sequence; identical to SEQ ID NO: 2669
  hemagglutinin__InfluenzaA__AFN18809

SEQ ID NO: 9349 - protein, 566 aa, Artificial Sequence; identical to SEQ ID NO: 3771
  hemagglutinin__InfluenzaA__AFN18816

SEQ ID NO: 9350 - protein, 566 aa, Artificial Sequence; identical to SEQ ID NO: 2669
  hemagglutinin__InfluenzaA__AFN18818

SEQ ID NO: 9351 - protein, 566 aa, Artificial Sequence
  hemagglutinin__InfluenzaA__AFN18820
MKAILVVLLYTFATANADTLCIGYHANNSTDTVDTVLEKNVTVTHSVNLLEDKHNGKLCKLRGVAPLHLGNCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9352 - protein, 566 aa, Artificial Sequence; identical to SEQ ID NO: 2669
  hemagglutinin__InfluenzaA__AFN18822

SEQ ID NO: 9353 - protein, 566 aa, Artificial Sequence
  hemagglutinin__InfluenzaA__AFN18824
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVRLESTRIYQILAIYSTVASSLVLVVSLGAISFWMCSNGSLQCRICI

SEQ ID NO: 9354 - protein, 566 aa, Artificial Sequence; identical to SEQ ID NO: 9277
  hemagglutinin__InfluenzaA__AFN18826

SEQ ID NO: 9355 - protein, 566 aa, Artificial Sequence
  hemagglutinin__InfluenzaA__AFN18828
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSIKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9356 - protein, 566 aa, Artificial Sequence; identical to SEQ ID NO: 9340
  hemagglutinin__InfluenzaA__AFN18830

SEQ ID NO: 9357 - protein, 566 aa, Artificial Sequence; identical to SEQ ID NO: 2669
  hemagglutinin__InfluenzaA__AFN18832

SEQ ID NO: 9358 - protein, 566 aa, Artificial Sequence; identical to SEQ ID NO: 3535
  hemagglutinin__InfluenzaA__AFN18834

SEQ ID NO: 9359 - protein, 566 aa, Artificial Sequence
  hemagglutinin__InfluenzaA__AFN18849
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNVDAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9360 - protein, 566 aa, Artificial Sequence
  hemagglutinin__InfluenzaA__AFN18856
MKAILVVLLYTFATANADTLCIGYHANNSTDTVDTVLEKNVTVTHSVNLLENKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9361 - protein, 566 aa, Artificial Sequence; identical to SEQ ID NO: 3530
  hemagglutinin__InfluenzaA__AFN18858

SEQ ID NO: 9362 - protein, 566 aa, Artificial Sequence
  hemagglutinin__InfluenzaA__AFN18860
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACSHAGAKSFYKNLIWLVKKGNSYPKLSKSYINDKGKEVLVLWGIHHPSTSADQQSLYQNADAYVFVGTSRYSKKFKPEIAIRPKVRDQEGRMDYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9363 - protein, 566 aa, Artificial Sequence
  hemagglutinin__InfluenzaA__AFN18865
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9364 - protein, 566 aa, Artificial Sequence
  hemagglutinin__InfluenzaA__AFN18875
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSAAQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9365 - protein, 566 aa, Artificial Sequence
  hemagglutinin__InfluenzaA__AFN18885
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTNLPFQNIHPITIGKCPKYVKSTKLRLATGLRNVPSTQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCKICI

SEQ ID NO: 9366 - protein, 566 aa, Artificial Sequence; identical to SEQ ID NO: 2669
  hemagglutinin__InfluenzaA__AFN18892

SEQ ID NO: 9367 - protein, 566 aa, Artificial Sequence; identical to SEQ ID NO: 2911
  hemagglutinin__InfluenzaA__AFN18894

SEQ ID NO: 9368 - protein, 566 aa, Artificial Sequence; identical to SEQ ID NO: 9333
  hemagglutinin__InfluenzaA__AFN18903

SEQ ID NO: 9369 - protein, 566 aa, Artificial Sequence; identical to SEQ ID NO: 3771
  hemagglutinin__InfluenzaA__AFN18910

SEQ ID NO: 9370 - protein, 566 aa, Artificial Sequence
  hemagglutinin__InfluenzaA__AFN18912
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTSVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9371 - protein, 566 aa, Artificial Sequence; identical to SEQ ID NO: 3771
  hemagglutinin__InfluenzaA__AFN18917

SEQ ID NO: 9372 - protein, 566 aa, Artificial Sequence; identical to SEQ ID NO: 2669
  hemagglutinin__InfluenzaA__AFN18927

SEQ ID NO: 9373 - protein, 566 aa, Artificial Sequence; identical to SEQ ID NO: 5335
  hemagglutinin__InfluenzaA__AFN18937

SEQ ID NO: 9374 - protein, 566 aa, Artificial Sequence
  hemagglutinin__InfluenzaA__AFN18952
MKAILVVLLYTFATANADTLCIGYHANNSTDTVDTVLEKNVTVTHSVNILEDKHNRKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 9375 - protein, 566 aa, Artificial Sequence
  hemagglutinin__InfluenzaA__AFN18957
MKAILVVLLYTFATANADTLCIGYHANNSTDTVDTVLEKNVTVTHSVNLLEDNHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9376 - protein, 566 aa, Artificial Sequence; identical to SEQ ID NO: 8758
  hemagglutinin__InfluenzaA__AFN18964

SEQ ID NO: 9377 - protein, 566 aa, Artificial Sequence
  hemagglutinin__InfluenzaA__AFN18974
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSMSSFERFEIFPKTSSWPNHDPNKGVTAACPHAGAKSFYKNLIWLVKKGNSYPKLSKSYINDKGKKVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSDEAKLNREEIDGVKLESTRIYQILAIYSTVASSLVLVVSLGAISFWMCSNGSLQCRICI

SEQ ID NO: 9378 - protein, 566 aa, Artificial Sequence; identical to SEQ ID NO: 4221
  hemagglutinin__InfluenzaA__AFN18979

SEQ ID NO: 9379 - protein, 566 aa, Artificial Sequence
  hemagglutinin__InfluenzaA__AFN18982
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 9380 - protein, 566 aa, Artificial Sequence; identical to SEQ ID NO: 9272
  hemagglutinin__InfluenzaA__AFN18984

SEQ ID NO: 9381 - protein, 566 aa, Artificial Sequence; identical to SEQ ID NO: 2669
  hemagglutinin__InfluenzaA__AFN18986

SEQ ID NO: 9382 - protein, 566 aa, Artificial Sequence; identical to SEQ ID NO: 2669
  hemagglutinin__InfluenzaA__AFN18988

SEQ ID NO: 9383 - protein, 566 aa, Artificial Sequence; identical to SEQ ID NO: 3833
  hemagglutinin__InfluenzaA__AFN18993

SEQ ID NO: 9384 - protein, 566 aa, Artificial Sequence; identical to SEQ ID NO: 3833
  hemagglutinin__InfluenzaA__AFN18999

SEQ ID NO: 9385 - protein, 566 aa, Artificial Sequence; identical to SEQ ID NO: 3467
  hemagglutinin__InfluenzaA__AFN19006

SEQ ID NO: 9386 - protein, 566 aa, Artificial Sequence; identical to SEQ ID NO: 2669
  hemagglutinin__InfluenzaA__AFN19026

SEQ ID NO: 9387 - protein, 566 aa, Artificial Sequence; identical to SEQ ID NO: 3809
  hemagglutinin__InfluenzaA__AFN19036

SEQ ID NO: 9388 - protein, 566 aa, Artificial Sequence; identical to SEQ ID NO: 2669
  hemagglutinin__InfluenzaA__AFN19043

SEQ ID NO: 9389 - protein, 566 aa, Artificial Sequence; identical to SEQ ID NO: 2669
  hemagglutinin__InfluenzaA__AFN19053

SEQ ID NO: 9390 - protein, 566 aa, Artificial Sequence; identical to SEQ ID NO: 2669
  hemagglutinin__InfluenzaA__AFN19063

SEQ ID NO: 9391 - protein, 566 aa, Artificial Sequence; identical to SEQ ID NO: 2669
  hemagglutinin__InfluenzaA__AFN19070

SEQ ID NO: 9392 - protein, 566 aa, Artificial Sequence
  hemagglutinin__InfluenzaA__AFN19076
MKAILVVLLYTFATANADTLCIGYHANNSTDTVDTVLEKDVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9393 - protein, 566 aa, Artificial Sequence; identical to SEQ ID NO: 2669
  hemagglutinin__InfluenzaA__AFN19082

SEQ ID NO: 9394 - protein, 566 aa, Artificial Sequence; identical to SEQ ID NO: 2669
  hemagglutinin__InfluenzaA__AFN19088

SEQ ID NO: 9395 - protein, 566 aa, Artificial Sequence; identical to SEQ ID NO: 2669
  hemagglutinin__InfluenzaA__AFN19097

SEQ ID NO: 9396 - protein, 566 aa, Artificial Sequence; identical to SEQ ID NO: 2669
  hemagglutinin__InfluenzaA__AFN19104

SEQ ID NO: 9397 - protein, 566 aa, Artificial Sequence; identical to SEQ ID NO: 2669
  hemagglutinin__InfluenzaA__AFN19113

SEQ ID NO: 9398 - protein, 566 aa, Artificial Sequence; identical to SEQ ID NO: 2669
  hemagglutinin__InfluenzaA__AFN19119

SEQ ID NO: 9399 - protein, 566 aa, Artificial Sequence; identical to SEQ ID NO: 5180
  hemagglutinin__InfluenzaA__AFN19125

SEQ ID NO: 9400 - protein, 566 aa, Artificial Sequence; identical to SEQ ID NO: 2669
  hemagglutinin__InfluenzaA__AFN19134

SEQ ID NO: 9401 - protein, 566 aa, Artificial Sequence; identical to SEQ ID NO: 2669
  hemagglutinin__InfluenzaA__AFN19144

SEQ ID NO: 9402 - protein, 566 aa, Artificial Sequence; identical to SEQ ID NO: 5224
  hemagglutinin__InfluenzaA__AFN19154

SEQ ID NO: 9403 - protein, 566 aa, Artificial Sequence; identical to SEQ ID NO: 2669
  hemagglutinin__InfluenzaA__AFN19164

SEQ ID NO: 9404 - protein, 566 aa, Artificial Sequence; identical to SEQ ID NO: 2669
  hemagglutinin__InfluenzaA__AFN19174

SEQ ID NO: 9405 - protein, 566 aa, Artificial Sequence; identical to SEQ ID NO: 2669
  hemagglutinin__InfluenzaA__AFN19184

SEQ ID NO: 9406 - protein, 566 aa, Artificial Sequence; identical to SEQ ID NO: 2669
  hemagglutinin__InfluenzaA__AFN19194

SEQ ID NO: 9407 - protein, 566 aa, Artificial Sequence; identical to SEQ ID NO: 2669
  hemagglutinin__InfluenzaA__AFN19203

SEQ ID NO: 9408 - protein, 566 aa, Artificial Sequence; identical to SEQ ID NO: 2669
  hemagglutinin__InfluenzaA__AFN19213

SEQ ID NO: 9409 - protein, 566 aa, Artificial Sequence; identical to SEQ ID NO: 2669
  hemagglutinin__InfluenzaA__AFN19223

SEQ ID NO: 9410 - protein, 566 aa, Artificial Sequence; identical to SEQ ID NO: 2669
  hemagglutinin__InfluenzaA__AFN19233

SEQ ID NO: 9411 - protein, 566 aa, Artificial Sequence
  hemagglutinin__InfluenzaA__AFN19243
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVQDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9412 - protein, 566 aa, Artificial Sequence; identical to SEQ ID NO: 4785
  hemagglutinin__InfluenzaA__AFN19250

SEQ ID NO: 9413 - protein, 566 aa, Artificial Sequence; identical to SEQ ID NO: 2669
  hemagglutinin__InfluenzaA__AFN19259

SEQ ID NO: 9414 - protein, 566 aa, Artificial Sequence; identical to SEQ ID NO: 2669
  hemagglutinin__InfluenzaA__AFN19269

SEQ ID NO: 9415 - protein, 566 aa, Artificial Sequence; identical to SEQ ID NO: 2669
  hemagglutinin__InfluenzaA__AFN19279

SEQ ID NO: 9416 - protein, 566 aa, Artificial Sequence; identical to SEQ ID NO: 3530
  hemagglutinin__InfluenzaA__AFN19286

SEQ ID NO: 9417 - protein, 566 aa, Artificial Sequence; identical to SEQ ID NO: 2669
  hemagglutinin__InfluenzaA__AFN19295

SEQ ID NO: 9418 - protein, 566 aa, Artificial Sequence; identical to SEQ ID NO: 2669
  hemagglutinin__InfluenzaA__AFN19305

SEQ ID NO: 9419 - protein, 566 aa, Artificial Sequence; identical to SEQ ID NO: 3535
  hemagglutinin__InfluenzaA__AFN19315

SEQ ID NO: 9420 - protein, 566 aa, Artificial Sequence; identical to SEQ ID NO: 2669
  hemagglutinin__InfluenzaA__AFN19325

SEQ ID NO: 9421 - protein, 566 aa, Artificial Sequence; identical to SEQ ID NO: 2669
  hemagglutinin__InfluenzaA__AFN19335

SEQ ID NO: 9422 - protein, 566 aa, Artificial Sequence; identical to SEQ ID NO: 2669
  hemagglutinin__InfluenzaA__AFN19344

SEQ ID NO: 9423 - protein, 566 aa, Artificial Sequence
  hemagglutinin__InfluenzaA__AFN19351
MKTIIALSYILCLVFAQKLPGNDNSMATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNVRCNICI

SEQ ID NO: 9424 - protein, 566 aa, Artificial Sequence; identical to SEQ ID NO: 9074
  hemagglutinin__InfluenzaA__AFN19355

SEQ ID NO: 9425 - protein, 566 aa, Artificial Sequence; identical to SEQ ID NO: 9074
  hemagglutinin__InfluenzaA__AFN19357

SEQ ID NO: 9426 - protein, 566 aa, Artificial Sequence; identical to SEQ ID NO: 9074
  hemagglutinin__InfluenzaA__AFN19361

SEQ ID NO: 9427 - protein, 566 aa, Artificial Sequence
  hemagglutinin__InfluenzaA__AFN19363
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9428 - protein, 566 aa, Artificial Sequence; identical to SEQ ID NO: 6982
  hemagglutinin__InfluenzaA__AFN19365

SEQ ID NO: 9429 - protein, 566 aa, Artificial Sequence
  hemagglutinin__InfluenzaA__AFN19367
MKTIIALSYILCLVFAQKLPENDNSTATLCLGHHAVPNGTIVKTITNDQIEVTNATELVQSSSTGEICDSPHQILDGVNCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIQSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9430 - protein, 566 aa, Artificial Sequence
  hemagglutinin__InfluenzaA__AFN19369
MKTIIALSYILCLVFAQKLPENDNSTATLCLGHHAVPNGTIVKTITNDQIEVTNATELVQSSSTGEICDSPHQILDGVNCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9431 - protein, 566 aa, Artificial Sequence
  hemagglutinin__InfluenzaA__AFN19373
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9432 - protein, 566 aa, Artificial Sequence; identical to SEQ ID NO: 9074
  hemagglutinin__InfluenzaA__AFN19375

SEQ ID NO: 9433 - protein, 566 aa, Artificial Sequence
  hemagglutinin__InfluenzaA__AFN19377
MKTIIALSYILCLVFAQKLPENDNSTATLCLGHHAVPNGTIVKTITNDQIEVTNATELVQSSSTGEICDSPHQILDGVNCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQNGNIRCNICI

SEQ ID NO: 9434 - protein, 566 aa, Artificial Sequence; identical to SEQ ID NO: 9074
  hemagglutinin__InfluenzaA__AFN19379

SEQ ID NO: 9435 - protein, 566 aa, Artificial Sequence; identical to SEQ ID NO: 9431
  hemagglutinin__InfluenzaA__AFN19381

SEQ ID NO: 9436 - protein, 566 aa, Artificial Sequence; identical to SEQ ID NO: 9430
  hemagglutinin__InfluenzaA__AFN19383

SEQ ID NO: 9437 - protein, 566 aa, Artificial Sequence
  hemagglutinin__InfluenzaA__AFN19385
MKTIIALSYILCLVFAQKLPENDNSTATLCLGHHAVPNGTIVKTITNDQIEVTNATELVQSSSTGEICDSPHQILDGVNCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIQSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDIWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9438 - protein, 566 aa, Artificial Sequence; identical to SEQ ID NO: 9430
  hemagglutinin__InfluenzaA__AFN19387

SEQ ID NO: 9439 - protein, 566 aa, Artificial Sequence; identical to SEQ ID NO: 9074
  hemagglutinin__InfluenzaA__AFN19389

SEQ ID NO: 9440 - protein, 566 aa, Artificial Sequence; identical to SEQ ID NO: 9074
  hemagglutinin__InfluenzaA__AFN19391

SEQ ID NO: 9441 - protein, 566 aa, Artificial Sequence
  hemagglutinin__InfluenzaA__AFN19393
MKTIIALSYILCLVFAQKLPGNDNSTATLCLGHHAVPNGTIVKTITNDQIEVTNATELVQSSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALSNRFQIKGVELKSGYKDWILWISFAISCFLLCVALLGFIMWACQKGNIRCNICI

SEQ ID NO: 9442 - protein, 566 aa, Artificial Sequence; identical to SEQ ID NO: 9430
  hemagglutinin__InfluenzaA__AFN19397

SEQ ID NO: 9443 - protein, 566 aa, Artificial Sequence; identical to SEQ ID NO: 9074
  hemagglutinin__InfluenzaA__AFN19399

SEQ ID NO: 9444 - protein, 566 aa, Artificial Sequence; identical to SEQ ID NO: 9430
  hemagglutinin__InfluenzaA__AFN19401

SEQ ID NO: 9445 - protein, 566 aa, Artificial Sequence; identical to SEQ ID NO: 9074
  hemagglutinin__InfluenzaA__AFN19403

SEQ ID NO: 9446 - protein, 566 aa, Artificial Sequence; identical to SEQ ID NO: 9430
  hemagglutinin__InfluenzaA__AFN19405

SEQ ID NO: 9447 - protein, 566 aa, Artificial Sequence
  hemagglutinin__InfluenzaA__AFN19407
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWSGVTQNGTSSACMRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9448 - protein, 566 aa, Artificial Sequence
  hemagglutinin__InfluenzaA__AFN19409
MKTIIALSYILCLVFAQKLPGNDNSTATLCLGHHAVPNGTIVKTITNDQIEVTNATELVQSSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9449 - protein, 566 aa, Artificial Sequence; identical to SEQ ID NO: 9430
  hemagglutinin__InfluenzaA__AFN19411

SEQ ID NO: 9450 - protein, 566 aa, Artificial Sequence; identical to SEQ ID NO: 9074
  hemagglutinin__InfluenzaA__AFN19413

SEQ ID NO: 9451 - protein, 566 aa, Artificial Sequence
  hemagglutinin__InfluenzaA__AFN19415
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSVMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9452 - protein, 566 aa, Artificial Sequence
  hemagglutinin__InfluenzaA__AFN19417
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLIASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9453 - protein, 566 aa, Artificial Sequence
  hemagglutinin__InfluenzaA__AFN19423
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9454 - protein, 566 aa, Artificial Sequence; identical to SEQ ID NO: 9430
  hemagglutinin__InfluenzaA__AFN19425

SEQ ID NO: 9455 - protein, 566 aa, Artificial Sequence
  hemagglutinin__InfluenzaA__AFN19437
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFRIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINRKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHYVYRDEALNNRFQIKGVELKSGYKDWILWISFAISCFLLCVALLGFIMWACQKGNIRCNICI

SEQ ID NO: 9456 - protein, 566 aa, Artificial Sequence
  hemagglutinin__InfluenzaA__AFN19439
MKTIIALSHILCLVFAQKLPENDNSTATLCLGHHAVPNGTIVKTITNDQIEVTNATELVQSSSTGEICDSPHQILDGINCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQPSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9457 - protein, 566 aa, Artificial Sequence; identical to SEQ ID NO: 9431
  hemagglutinin__InfluenzaA__AFN19443

SEQ ID NO: 9458 - protein, 566 aa, Artificial Sequence
  hemagglutinin__InfluenzaA__AFN19445
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLRLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9459 - protein, 566 aa, Artificial Sequence; identical to SEQ ID NO: 9453
  hemagglutinin__InfluenzaA__AFN19447

SEQ ID NO: 9460 - protein, 566 aa, Artificial Sequence
  hemagglutinin__InfluenzaA__AFN19451
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQINGVELKSGYKDWILWISFAISCFLLCVALLGFIMWACQKGNIRCNICI

SEQ ID NO: 9461 - protein, 566 aa, Artificial Sequence
  hemagglutinin__InfluenzaA__AFN19453
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQVKGVELKSGYKDWILWISFAISCFLLCVALLGFIMWACQKGNIRCNICI

SEQ ID NO: 9462 - protein, 566 aa, Artificial Sequence; identical to SEQ ID NO: 9453
  hemagglutinin__InfluenzaA__AFN19455

SEQ ID NO: 9463 - protein, 566 aa, Artificial Sequence; identical to SEQ ID NO: 9074
  hemagglutinin__InfluenzaA__AFN19457

SEQ ID NO: 9464 - protein, 566 aa, Artificial Sequence; identical to SEQ ID NO: 9074
  hemagglutinin__InfluenzaA__AFN19459

SEQ ID NO: 9465 - protein, 566 aa, Artificial Sequence; identical to SEQ ID NO: 9431
  hemagglutinin__InfluenzaA__AFN19461

SEQ ID NO: 9466 - protein, 566 aa, Artificial Sequence
  hemagglutinin__InfluenzaA__AFN19465
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDIGNGCFKIYHKCDNACIGSIRNGTYNHDVYRDEALNNRFQIKGVELKSGYKDWILWISFAISCFLLCIALLGFIMWACQKGNIRCNICI

SEQ ID NO: 9467 - protein, 566 aa, Artificial Sequence; identical to SEQ ID NO: 9453
  hemagglutinin__InfluenzaA__AFN19467

SEQ ID NO: 9468 - protein, 566 aa, Artificial Sequence; identical to SEQ ID NO: 9461
  hemagglutinin__InfluenzaA__AFN19469

SEQ ID NO: 9469 - protein, 566 aa, Artificial Sequence; identical to SEQ ID NO: 9074
  hemagglutinin__InfluenzaA__AFN19471

SEQ ID NO: 9470 - protein, 566 aa, Artificial Sequence
  hemagglutinin__InfluenzaA__AFN19473
MKTIIALSYILCLVFAQKLPGNDNSTATLCLGHHAVPNGTIVKTITNDQIEVTNATELVQSSSTGEICGSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9471 - protein, 566 aa, Artificial Sequence; identical to SEQ ID NO: 9453
  hemagglutinin__InfluenzaA__AFN19475

SEQ ID NO: 9472 - protein, 566 aa, Artificial Sequence; identical to SEQ ID NO: 9074
  hemagglutinin__InfluenzaA__AFN19477

SEQ ID NO: 9473 - protein, 566 aa, Artificial Sequence
  hemagglutinin__InfluenzaA__AFN19479
MKTIIALSCILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9474 - protein, 566 aa, Artificial Sequence; identical to SEQ ID NO: 9453
  hemagglutinin__InfluenzaA__AFN19483

SEQ ID NO: 9475 - protein, 566 aa, Artificial Sequence; identical to SEQ ID NO: 6855
  hemagglutinin__InfluenzaA__AFN19485

SEQ ID NO: 9476 - protein, 566 aa, Artificial Sequence; identical to SEQ ID NO: 9074
  hemagglutinin__InfluenzaA__AFN19487

SEQ ID NO: 9477 - protein, 566 aa, Artificial Sequence
  hemagglutinin__InfluenzaA__AFN19491
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 9478 - protein, 566 aa, Artificial Sequence
  hemagglutinin__InfluenzaA__AFN19493
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQTVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9479 - protein, 566 aa, Artificial Sequence
  hemagglutinin__InfluenzaA__AFN19495
MKTIIALSYILCLVFAQKIPGNDNSTATLCLGHHAVPNGTIVKTITNDQIEVTNATELVQSSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFATSCFLLCVALLGFIMWACQKGNIRCNICI

SEQ ID NO: 9480 - protein, 566 aa, Artificial Sequence
  hemagglutinin__InfluenzaA__AFN19497
MKTIIALSYILCLVFAQKLPENDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSTCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9481 - protein, 566 aa, Artificial Sequence; identical to SEQ ID NO: 9431
  hemagglutinin__InfluenzaA__AFN19499

SEQ ID NO: 9482 - protein, 566 aa, Artificial Sequence; identical to SEQ ID NO: 9430
  hemagglutinin__InfluenzaA__AFN19501

SEQ ID NO: 9483 - protein, 566 aa, Artificial Sequence; identical to SEQ ID NO: 6982
  hemagglutinin__InfluenzaA__AFN19503

SEQ ID NO: 9484 - protein, 566 aa, Artificial Sequence; identical to SEQ ID NO: 9431
  hemagglutinin__InfluenzaA__AFN19507

SEQ ID NO: 9485 - protein, 566 aa, Artificial Sequence; identical to SEQ ID NO: 9430
  hemagglutinin__InfluenzaA__AFN19509

SEQ ID NO: 9486 - protein, 566 aa, Artificial Sequence; identical to SEQ ID NO: 9431
  hemagglutinin__InfluenzaA__AFN19513

SEQ ID NO: 9487 - protein, 566 aa, Artificial Sequence; identical to SEQ ID NO: 9430
  hemagglutinin__InfluenzaA__AFN19515

SEQ ID NO: 9488 - protein, 566 aa, Artificial Sequence; identical to SEQ ID NO: 9431
  hemagglutinin__InfluenzaA__AFN19517

SEQ ID NO: 9489 - protein, 566 aa, Artificial Sequence; identical to SEQ ID NO: 9431
  hemagglutinin__InfluenzaA__AFN19519

SEQ ID NO: 9490 - protein, 566 aa, Artificial Sequence; identical to SEQ ID NO: 9074
  hemagglutinin__InfluenzaA__AFN19521

SEQ ID NO: 9491 - protein, 566 aa, Artificial Sequence; identical to SEQ ID NO: 9430
  hemagglutinin__InfluenzaA__AFN19523

SEQ ID NO: 9492 - protein, 566 aa, Artificial Sequence
  hemagglutinin__InfluenzaA__AFN19527
MKTIIALSYTLCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9493 - protein, 566 aa, Artificial Sequence
  hemagglutinin__InfluenzaA__AFN19529
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9494 - protein, 566 aa, Artificial Sequence; identical to SEQ ID NO: 9074
  hemagglutinin__InfluenzaA__AFN19531

SEQ ID NO: 9495 - protein, 566 aa, Artificial Sequence; identical to SEQ ID NO: 9493
  hemagglutinin__InfluenzaA__AFN19533

SEQ ID NO: 9496 - protein, 566 aa, Artificial Sequence
  hemagglutinin__InfluenzaA__AFN19535
MKTIIALSYILCLVFAQKIPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9497 - protein, 566 aa, Artificial Sequence; identical to SEQ ID NO: 9074
  hemagglutinin__InfluenzaA__AFN19537

SEQ ID NO: 9498 - protein, 566 aa, Artificial Sequence; identical to SEQ ID NO: 9074
  hemagglutinin__InfluenzaA__AFN19539

SEQ ID NO: 9499 - protein, 566 aa, Artificial Sequence; identical to SEQ ID NO: 9074
  hemagglutinin__InfluenzaA__AFN19543

SEQ ID NO: 9500 - protein, 566 aa, Artificial Sequence
  hemagglutinin__InfluenzaA__AFN19545
MKTIIALSYILCLVFAQKLPGSDNSTATLCLGHHAVPNGTIVKTITNDRIEVTNATELVQNSSIGEICDSPHQILDGENCTLIDALLGDPQCDGFKNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIQSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9501 - protein, 566 aa, Artificial Sequence; identical to SEQ ID NO: 9074
  hemagglutinin__InfluenzaA__AFN19547

SEQ ID NO: 9502 - protein, 566 aa, Artificial Sequence
  hemagglutinin__InfluenzaA__AFN19549
MKTIIALSYILCLVFAQKLPGNDNSTATLCLGHHAVPNGTIVKTITNDQIEVTNATELVQSSSKGEICNSPHQILDGGNCTLIDALLGDPQCDGFQNKKWDLFVERSKAHSNCYPYDVPDYASLRSLVASSGTLEFNNESFNWTGVTQNGTSSACMRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDIEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9503 - protein, 566 aa, Artificial Sequence
  hemagglutinin__InfluenzaA__AFN19551
MKTIIALSYILCLVFAQKIPGNDNSTATLCLGHHAVPNGTIVKTITNDQIEVTNATELVQSSSTGEICDSPHQILDGENCTLIDALLGDPHCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9504 - protein, 566 aa, Artificial Sequence; identical to SEQ ID NO: 9453
  hemagglutinin__InfluenzaA__AFN19553

SEQ ID NO: 9505 - protein, 566 aa, Artificial Sequence; identical to SEQ ID NO: 9453
  hemagglutinin__InfluenzaA__AFN19555

SEQ ID NO: 9506 - protein, 566 aa, Artificial Sequence; identical to SEQ ID NO: 9074
  hemagglutinin__InfluenzaA__AFN19557

SEQ ID NO: 9507 - protein, 566 aa, Artificial Sequence; identical to SEQ ID NO: 9453
  hemagglutinin__InfluenzaA__AFN19559

SEQ ID NO: 9508 - protein, 566 aa, Artificial Sequence; identical to SEQ ID NO: 9461
  hemagglutinin__InfluenzaA__AFN19561

SEQ ID NO: 9509 - protein, 566 aa, Artificial Sequence
  hemagglutinin__InfluenzaA__AFN19563
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFATSCFLLCVALLGFIMWACQKGNIRCNICI

SEQ ID NO: 9510 - protein, 566 aa, Artificial Sequence; identical to SEQ ID NO: 9431
  hemagglutinin__InfluenzaA__AFN19565

SEQ ID NO: 9511 - protein, 566 aa, Artificial Sequence
  hemagglutinin__InfluenzaA__AFN19567
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9512 - protein, 566 aa, Artificial Sequence; identical to SEQ ID NO: 9074
  hemagglutinin__InfluenzaA__AFN19569

SEQ ID NO: 9513 - protein, 566 aa, Artificial Sequence
  hemagglutinin__InfluenzaA__AFN19571
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYSQSSGRITVSTKRSQQAVIPNIGSRPRIRNIPSRISIYWTIVKPGDILLINSTGNLIAPRGYFRIRSGKSSIMRSDAPIGKCNSECITPNGSIPNDKPFQNVNRITYGPCPRYVKQSTLKLATGMRNVPEKQTRGIFGAIAGFIENGWEGMVDGWYGYRHQNSEGRGQAADLKSTQAAIDQINGKLNRLIGKTNEKFHQIEKEFSEVEGRIQDLEKYVEDTKIDLWTYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9514 - protein, 566 aa, Artificial Sequence
  hemagglutinin__InfluenzaA__AFN19573
MKTIIALSYILCLVFAQKLPGNDNSTATLCLGHHAVPNGTIVKTITNDQIEVTNATELVQSSSTGKICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYSALNVTMPNKEQFDKLYIWGVHHPGTDKDQISLYAQASGRITVSTKRSQQTVIPNIGSRPRVRNIPSRISIYWTIVKPGDILLINSTGNLIAPRGYFKMQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9515 - protein, 566 aa, Artificial Sequence
  hemagglutinin__InfluenzaA__AFN19575
MKTIIALSYILCLVFAQKLPGNDNSTATLCLGHHAVPNGTIVKTITNDQIEVTNATELVQSSSTGEICDNPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9516 - protein, 566 aa, Artificial Sequence; identical to SEQ ID NO: 9430
  hemagglutinin__InfluenzaA__AFN19577

SEQ ID NO: 9517 - protein, 566 aa, Artificial Sequence; identical to SEQ ID NO: 9430
  hemagglutinin__InfluenzaA__AFN19579

SEQ ID NO: 9518 - protein, 566 aa, Artificial Sequence; identical to SEQ ID NO: 9430
  hemagglutinin__InfluenzaA__AFN19581

SEQ ID NO: 9519 - protein, 566 aa, Artificial Sequence; identical to SEQ ID NO: 9430
  hemagglutinin__InfluenzaA__AFN19583

SEQ ID NO: 9520 - protein, 566 aa, Artificial Sequence
  hemagglutinin__InfluenzaA__AFN19587
MKTIIALSYILCLVFAQKLPENDNSTATLCLGHHAVPNGTIVKTITNDQIEVTNATELVQSSSTGEICDSPHQILDGVNCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHECDNACIGSIRNGTYNHDVYRDEALNNRFQIKGVELKSGYKDWILWISFAISCFLLCVALLGFIMWACQKGNIRCNICI

SEQ ID NO: 9521 - protein, 566 aa, Artificial Sequence; identical to SEQ ID NO: 9430
  hemagglutinin__InfluenzaA__AFN19589

SEQ ID NO: 9522 - protein, 566 aa, Artificial Sequence
  hemagglutinin__InfluenzaA__AFN19591
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACMRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQNGNIRCNICI

SEQ ID NO: 9523 - protein, 566 aa, Artificial Sequence; identical to SEQ ID NO: 9430
  hemagglutinin__InfluenzaA__AFN19593

SEQ ID NO: 9524 - protein, 566 aa, Artificial Sequence; identical to SEQ ID NO: 9431
  hemagglutinin__InfluenzaA__AFN19595

SEQ ID NO: 9525 - protein, 566 aa, Artificial Sequence; identical to SEQ ID NO: 9431
  hemagglutinin__InfluenzaA__AFN19599

SEQ ID NO: 9526 - protein, 566 aa, Artificial Sequence; identical to SEQ ID NO: 9493
  hemagglutinin__InfluenzaA__AFN19601

SEQ ID NO: 9527 - protein, 566 aa, Artificial Sequence; identical to SEQ ID NO: 9074
  hemagglutinin__InfluenzaA__AFN19607

SEQ ID NO: 9528 - protein, 566 aa, Artificial Sequence; identical to SEQ ID NO: 9430
  hemagglutinin__InfluenzaA__AFN19609

SEQ ID NO: 9529 - protein, 566 aa, Artificial Sequence
  hemagglutinin__InfluenzaA__AFN19611
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVEPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9530 - protein, 566 aa, Artificial Sequence; identical to SEQ ID NO: 9453
  hemagglutinin__InfluenzaA__AFN19613

SEQ ID NO: 9531 - protein, 566 aa, Artificial Sequence; identical to SEQ ID NO: 9431
  hemagglutinin__InfluenzaA__AFN19617

SEQ ID NO: 9532 - protein, 566 aa, Artificial Sequence
  hemagglutinin__InfluenzaA__AFN19619
MKTIIALSHILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSKPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 9533 - protein, 566 aa, Artificial Sequence; identical to SEQ ID NO: 9493
  hemagglutinin__InfluenzaA__AFN19623

SEQ ID NO: 9534 - protein, 566 aa, Artificial Sequence; identical to SEQ ID NO: 9430
  hemagglutinin__InfluenzaA__AFN19629

SEQ ID NO: 9535 - protein, 566 aa, Artificial Sequence
  hemagglutinin__InfluenzaA__AFN19631
MKTIIALSYILCLVFAQKLPENDYSTATLCLGHHAVPNGTIVKTITNDQIEVTNATELVQSSSTGEICDSPHQILDGINCTLIDALLGDPQCDGFQNKKWDLFVERSKAYSNCYPYDVPDYASLRSLVASSGTLEFNNESFNWTGVTQNGTSSACIRRSTSSFFSRLNWLTHLNFKYPALNVTMPNNEQFDKLYIWGVHHPGTDKDQIFLYAQPSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9536 - protein, 566 aa, Artificial Sequence
  hemagglutinin__InfluenzaA__AFN19633
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITISTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9537 - protein, 566 aa, Artificial Sequence
  hemagglutinin__InfluenzaA__AFN19635
MKTIIALSYILCLVFAQKLPENDNSTATLCLGHHAVPNGTIVKTITNDQIEVTNATELVQSSSTGEICDSPHQILDGINCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQPSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9538 - protein, 566 aa, Artificial Sequence; identical to SEQ ID NO: 9537
  hemagglutinin__InfluenzaA__AFN19637

SEQ ID NO: 9539 - protein, 566 aa, Artificial Sequence; identical to SEQ ID NO: 9074
  hemagglutinin__InfluenzaA__AFN19639

SEQ ID NO: 9540 - protein, 566 aa, Artificial Sequence; identical to SEQ ID NO: 9493
  hemagglutinin__InfluenzaA__AFN19641

SEQ ID NO: 9541 - protein, 566 aa, Artificial Sequence; identical to SEQ ID NO: 9537
  hemagglutinin__InfluenzaA__AFN19643

SEQ ID NO: 9542 - protein, 566 aa, Artificial Sequence; identical to SEQ ID NO: 9074
  hemagglutinin__InfluenzaA__AFN19645

SEQ ID NO: 9543 - protein, 566 aa, Artificial Sequence
  hemagglutinin__InfluenzaA__AFN19647
MKTIIALSYILCLVFAQKLPENDNSTATLCLGHHAVPNGTIVKTITNDQIEVTNATELVQSSSTGEICDSPHQILDGVNCTLIDALLGDPQCDGFQNKKWDLFVERSKAYSNCYPYDVPDYASLKSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIQSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9544 - protein, 566 aa, Artificial Sequence
  hemagglutinin__InfluenzaA__AFN19649
MKTIIALSYILCLVFAQKLPGNDNSTATLCLGHHAVPNGTIVKTITNDQIEVTNATELVQNSSISEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9545 - protein, 566 aa, Artificial Sequence; identical to SEQ ID NO: 9537
  hemagglutinin__InfluenzaA__AFN19653

SEQ ID NO: 9546 - protein, 566 aa, Artificial Sequence; identical to SEQ ID NO: 9453
  hemagglutinin__InfluenzaA__AFN19663

SEQ ID NO: 9547 - protein, 566 aa, Artificial Sequence; identical to SEQ ID NO: 9461
  hemagglutinin__InfluenzaA__AFN19665

SEQ ID NO: 9548 - protein, 566 aa, Artificial Sequence
  hemagglutinin__InfluenzaA__AFN19667
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACMRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9549 - protein, 566 aa, Artificial Sequence
  hemagglutinin__InfluenzaA__AFN19669
MKTIIALSYILCMVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPNYASLRSLVASSGTLEFNNESFNWTGVTQNGTSSACMRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9550 - protein, 566 aa, Artificial Sequence
  hemagglutinin__InfluenzaA__AFN19671
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 9551 - protein, 566 aa, Artificial Sequence; identical to SEQ ID NO: 9074
  hemagglutinin__InfluenzaA__AFN19674

SEQ ID NO: 9552 - protein, 566 aa, Artificial Sequence; identical to SEQ ID NO: 9074
  hemagglutinin__InfluenzaA__AFN19676

SEQ ID NO: 9553 - protein, 566 aa, Artificial Sequence; identical to SEQ ID NO: 9461
  hemagglutinin__InfluenzaA__AFN19678

SEQ ID NO: 9554 - protein, 566 aa, Artificial Sequence
  hemagglutinin__InfluenzaA__AFN19682
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPNYASLRSLVASSGTLEFNNESFNWTGVTQNGTSSACMRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIKCNICI

SEQ ID NO: 9555 - protein, 566 aa, Artificial Sequence
  hemagglutinin__InfluenzaA__AFN19684
MKTIIALSYILCLAFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHNVYRDEALNNRFQIKGVELKSGYKDWILWISFAISCFLLCVALLGFIMWACQKGNIRCNICI

SEQ ID NO: 9556 - protein, 566 aa, Artificial Sequence
  hemagglutinin__InfluenzaA__AFN19686
MKTIIALSYILCLAFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNIPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHNVYRDEALNNRFQIKGVELKSGYKDWILWISFAISCFLLCVALLGFIMWACQKGNIRCNICI

SEQ ID NO: 9557 - protein, 566 aa, Artificial Sequence
  hemagglutinin__InfluenzaA__AFN19688
MKTIIALSYILCLVFAQELPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9558 - protein, 566 aa, Artificial Sequence
  hemagglutinin__InfluenzaA__AFN19690
MKTTIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVDLKSGYKDWILWISFAISCFLLCVALLGFIMWACQKGNIRCNICI

SEQ ID NO: 9559 - protein, 566 aa, Artificial Sequence
  hemagglutinin__InfluenzaA__AFN19692
MKTIIALSYILCLVFAQKIPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSDSSFFSRLNWLTHLNFKYPALNVTMPNNEQFDKLYIWGVHHPGTDKDQIFLYAQASGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9560 - protein, 566 aa, Artificial Sequence
  hemagglutinin__InfluenzaA__AFN19694
MKTIIALSYILCLVFAQKLPGNDNSTATLCLGHHAVPNGTIVKTITNDRIEVTNATELVQNSPIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9561 - protein, 566 aa, Artificial Sequence
  hemagglutinin__InfluenzaA__AFN19700
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNERFNWSGVTQNGTSSACMRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9562 - protein, 566 aa, Artificial Sequence
  hemagglutinin__InfluenzaA__AFN19702
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERGKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9563 - protein, 566 aa, Artificial Sequence; identical to SEQ ID NO: 6815
  hemagglutinin__InfluenzaA__AFN19709

SEQ ID NO: 9564 - protein, 566 aa, Artificial Sequence
  hemagglutinin__InfluenzaA__AFN19719
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRTQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 9565 - protein, 566 aa, Artificial Sequence; identical to SEQ ID NO: 6435
  hemagglutinin__InfluenzaA__AFN19730

SEQ ID NO: 9566 - protein, 566 aa, Artificial Sequence; identical to SEQ ID NO: 6815
  hemagglutinin__InfluenzaA__AFN19736

SEQ ID NO: 9567 - protein, 566 aa, Artificial Sequence
  hemagglutinin__InfluenzaA__AFN19748
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKTGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9568 - protein, 566 aa, Artificial Sequence; identical to SEQ ID NO: 6824
  hemagglutinin__InfluenzaA__AFN19757

SEQ ID NO: 9569 - protein, 566 aa, Artificial Sequence; identical to SEQ ID NO: 6815
  hemagglutinin__InfluenzaA__AFN19768

SEQ ID NO: 9570 - protein, 566 aa, Artificial Sequence
  hemagglutinin__InfluenzaA__AFN19781
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAVERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9571 - protein, 566 aa, Artificial Sequence
  hemagglutinin__InfluenzaA__AFN19791
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLIVSLGAISFWMCSNGSLQCRICI

SEQ ID NO: 9572 - protein, 566 aa, Artificial Sequence; identical to SEQ ID NO: 6815
  hemagglutinin__InfluenzaA__AFN19806

SEQ ID NO: 9573 - protein, 566 aa, Artificial Sequence
  hemagglutinin__InfluenzaA__AFN19808
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVNSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9574 - protein, 566 aa, Artificial Sequence; identical to SEQ ID NO: 6824
  hemagglutinin__InfluenzaA__AFN19814

SEQ ID NO: 9575 - protein, 566 aa, Artificial Sequence
  hemagglutinin__InfluenzaA__AFN19816
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9576 - protein, 566 aa, Artificial Sequence
  hemagglutinin__InfluenzaA__AFN19821
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKLKPEIAIRPKVRDQEGRMNYYWTLVEPGGKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9577 - protein, 566 aa, Artificial Sequence; identical to SEQ ID NO: 6435
  hemagglutinin__InfluenzaA__AFN19831

SEQ ID NO: 9578 - protein, 566 aa, Artificial Sequence
  hemagglutinin__InfluenzaA__AFN19849
MKAILVVLLYTFATANADTLCIGYHANNSTDTVDTVLEKNVTVTHSVNLLEDKHNGKLCKLRGVAPLHLGKCDIAGWILGNPECESLSTASSWSYIVETSSSDNGTCYPGDFINYEELREQLSSVSSFERFEIFPKTSSWPNHDSNKGVTAACPQAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGDGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9579 - protein, 566 aa, Artificial Sequence
  hemagglutinin__InfluenzaA__AFN19865
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTLVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9580 - protein, 566 aa, Artificial Sequence
  hemagglutinin__InfluenzaA__AFN19875
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGEKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9581 - protein, 566 aa, Artificial Sequence
  hemagglutinin__InfluenzaA__AFN19895
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKISKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGRCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREVIDGVKLESTRIYQILAIYSTVASSLVLVVSLGAISFWMCSNGSLQCRICI

SEQ ID NO: 9582 - protein, 566 aa, Artificial Sequence
  hemagglutinin__InfluenzaA__AFN19905
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAVDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLIVSLGAISFWMCSNGSLQCRICI

SEQ ID NO: 9583 - protein, 566 aa, Artificial Sequence
  hemagglutinin__InfluenzaA__AFN19915
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPQAGAKSFYKNLIWLVKKGNSYPKLSSSYINDKGKEVLVLWGIHHPSTSADQQSLYQNADAYVFVGTSEYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9584 - protein, 566 aa, Artificial Sequence
  hemagglutinin__InfluenzaA__AFN19922
MKAILVVVLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSRSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPAQDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9585 - protein, 566 aa, Artificial Sequence; identical to SEQ ID NO: 6454
  hemagglutinin__InfluenzaA__AFN19931

SEQ ID NO: 9586 - protein, 566 aa, Artificial Sequence
  hemagglutinin__InfluenzaA__AFN19941
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFINYEELREQLSSVSSFERFEIFPKTSSWPNHDSNKGVTAACPQAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9587 - protein, 566 aa, Artificial Sequence
  hemagglutinin__InfluenzaA__AFN19951
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 9588 - protein, 566 aa, Artificial Sequence; identical to SEQ ID NO: 6815
  hemagglutinin__InfluenzaA__AFN19966

SEQ ID NO: 9589 - protein, 566 aa, Artificial Sequence
  hemagglutinin__InfluenzaA__AFN19972
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDNEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 9590 - protein, 566 aa, Artificial Sequence
  hemagglutinin__InfluenzaA__AFN19978
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 9591 - protein, 566 aa, Artificial Sequence; identical to SEQ ID NO: 6815
  hemagglutinin__InfluenzaA__AFN19983

SEQ ID NO: 9592 - protein, 566 aa, Artificial Sequence
  hemagglutinin__InfluenzaA__AFN19993
MKAILVVLLYTVATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9593 - protein, 566 aa, Artificial Sequence; identical to SEQ ID NO: 6815
  hemagglutinin__InfluenzaA__AFN20000

SEQ ID NO: 9594 - protein, 566 aa, Artificial Sequence; identical to SEQ ID NO: 6822
  hemagglutinin__InfluenzaA__AFN20006

SEQ ID NO: 9595 - protein, 566 aa, Artificial Sequence; identical to SEQ ID NO: 6454
  hemagglutinin__InfluenzaA__AFN20012

SEQ ID NO: 9596 - protein, 566 aa, Artificial Sequence
  hemagglutinin__InfluenzaA__AFN20018
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPQAGAKSFYKNLIWLVKKGNSYPKLSNSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9597 - protein, 566 aa, Artificial Sequence; identical to SEQ ID NO: 6824
  hemagglutinin__InfluenzaA__AFN20019

SEQ ID NO: 9598 - protein, 566 aa, Artificial Sequence; identical to SEQ ID NO: 6454
  hemagglutinin__InfluenzaA__AFN20021

SEQ ID NO: 9599 - protein, 566 aa, Artificial Sequence; identical to SEQ ID NO: 6824
  hemagglutinin__InfluenzaA__AFN20034

SEQ ID NO: 9600 - protein, 566 aa, Artificial Sequence; identical to SEQ ID NO: 6815
  hemagglutinin__InfluenzaA__AFN20040

SEQ ID NO: 9601 - protein, 566 aa, Artificial Sequence; identical to SEQ ID NO: 9587
  hemagglutinin__InfluenzaA__AFN20046

SEQ ID NO: 9602 - protein, 566 aa, Artificial Sequence; identical to SEQ ID NO: 6824
  hemagglutinin__InfluenzaA__AFN20052

SEQ ID NO: 9603 - protein, 566 aa, Artificial Sequence; identical to SEQ ID NO: 6824
  hemagglutinin__InfluenzaA__AFN20061

SEQ ID NO: 9604 - protein, 566 aa, Artificial Sequence
  hemagglutinin__InfluenzaA__AFN20076
MKAILVVLLYTFATANADTLCIGYHANNSTDTVDTVLEKNVTVTHSVNLLEDKHNGKLCKLRGVAPLHLGKCNIAGWILGNPDCESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9605 - protein, 566 aa, Artificial Sequence
  hemagglutinin__InfluenzaA__AFN20081
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKISKSYINDKGKEVLVLWGIHHPSTTADQQSLYQNADTYVFVGTSRYSKKFKPEIAIRPKVRDQEGRMNYYWTLVEPGDKITFEATGNLVIPRYAFAMERNAGSGIIISDTPVHDCNTTCQTPKGAINTSLPFQNIHPITIGRCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREVIDGVKLESTRIYQILAIYSTVASSLVLVVSLGAISFWMCSNGSLQCRICI

SEQ ID NO: 9606 - protein, 566 aa, Artificial Sequence; identical to SEQ ID NO: 6824
  hemagglutinin__InfluenzaA__AFN20092

SEQ ID NO: 9607 - protein, 566 aa, Artificial Sequence; identical to SEQ ID NO: 9586
  hemagglutinin__InfluenzaA__AFN20099

SEQ ID NO: 9608 - protein, 566 aa, Artificial Sequence
  hemagglutinin__InfluenzaA__AFN20112
MKAILVVLLYTFATANADTLCIGYHANNSTDTVDTVLEKNVTVTHSVNLLEDKHNGKLCKLRGVAPLHLGKCNIAGWILGNPECKSLSTASSWSYIVETSSSDNGTCYPGDFIDYEELREQLSSVSSFERFEIFPKTSSWPNHNPNKGVTAACPHAGAKSFYKNLIWLVKNGNSYPKLNTSYINDKGKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAFDKITNKVNSVIEKMNTQFTAVGKEFNHLEKRIENLNKKVDDGFLDIWTYNAELLVLLENERTLDYHDSNVKNLYEKVRSQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9609 - protein, 566 aa, Artificial Sequence
  hemagglutinin__InfluenzaA__AFN87924
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSTSYINDKRKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAFDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9610 - protein, 566 aa, Artificial Sequence; identical to SEQ ID NO: 2669
  hemagglutinin__InfluenzaA__AFN87926

SEQ ID NO: 9611 - protein, 566 aa, Artificial Sequence
  hemagglutinin__InfluenzaA__AFN87927
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKRKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISGTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNRVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9612 - protein, 566 aa, Artificial Sequence
  hemagglutinin__InfluenzaA__AFN87928
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLAVSLGAISFWMCSNGSLQCRICI

SEQ ID NO: 9613 - protein, 566 aa, Artificial Sequence; identical to SEQ ID NO: 3833
  hemagglutinin__InfluenzaA__AFN87929

SEQ ID NO: 9614 - protein, 566 aa, Artificial Sequence; identical to SEQ ID NO: 3833
  hemagglutinin__InfluenzaA__AFN87930

SEQ ID NO: 9615 - protein, 566 aa, Artificial Sequence
  hemagglutinin__InfluenzaA__AFN87931
MKAILVVLLYTFATANADTLCIGYHANNSTDTVDTVLEKNVTVTHSVNLLEEKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSIYQNADAYVFVGTSRYSKKFKPEIAIRPKVRDQEGRMNYYWTLVEPGDKITFEATGNLVVPRYAFTMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9616 - protein, 566 aa, Artificial Sequence
  hemagglutinin__InfluenzaA__AFN87932
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9617 - protein, 566 aa, Artificial Sequence; identical to SEQ ID NO: 3833
  hemagglutinin__InfluenzaA__AFN87933

SEQ ID NO: 9618 - protein, 566 aa, Artificial Sequence
  hemagglutinin__InfluenzaA__AFN87934
MKAILVVMLYTFATANADTLCIGYHANNSTDTVDTVLEKNVTVTHSVNLLEDKHNGKLCKLRGVAPLQLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9619 - protein, 566 aa, Artificial Sequence
  hemagglutinin__InfluenzaA__AFN87936
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFIDYEELREQLSSVSSFERFEIFPKTSSWPNHDPNKGVTAACPHAGAKSFYKNLIWLVKKGNSYPKLSTSYINDKGKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNVHPITIGKCPKYVKSTKLRLATGLRIVPSIQSRGLFGAIAGFIEGGWTGMVDGWYGYHHQNEQGSGYAADLKSTQNAFDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9620 - protein, 566 aa, Artificial Sequence
  hemagglutinin__InfluenzaA__AFN87938
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTSKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9621 - protein, 566 aa, Artificial Sequence
  hemagglutinin__InfluenzaA__AFN87939
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSTSYINDKGKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9622 - protein, 566 aa, Artificial Sequence
  hemagglutinin__InfluenzaA__AFN87941
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9623 - protein, 566 aa, Artificial Sequence
  hemagglutinin__InfluenzaA__AFN87943
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFIDYEELREQLSSVSSFERFEIFPKTSSWPNHDPNKGVTAACPHAGAKSFYKNLIWLVKKGNSYPKLSTSYINDKGKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9624 - protein, 566 aa, Artificial Sequence
  hemagglutinin__InfluenzaA__AFN87945
MKAILVVLLYTFATANADTLCIGYHANNSTDTVDTVLEKNVTVTHSVNLLEDKHDGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSQSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9625 - protein, 566 aa, Artificial Sequence
  hemagglutinin__InfluenzaA__AFN87947
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSTSYINDKGKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAFDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9626 - protein, 566 aa, Artificial Sequence
  hemagglutinin__InfluenzaA__AFN87949
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9627 - protein, 566 aa, Artificial Sequence; identical to SEQ ID NO: 6940
  hemagglutinin__InfluenzaA__AFN87951

SEQ ID NO: 9628 - protein, 566 aa, Artificial Sequence
  hemagglutinin__InfluenzaA__AFN87953
MKAILVVLLYTFATANADTLCIGYHANNSTDTVDTVLEKNVTVTHSANLLEDKHNGKLCKLRGVAPLHLGKCNIAGWILGNPECESLSTASSWSYIVETSSSDNGTCYPGDFIDYEELREQLSSVSSFERFEIFPKTSSWPNHDLNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9629 - protein, 566 aa, Artificial Sequence
  hemagglutinin__InfluenzaA__AFN87955
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9630 - protein, 566 aa, Artificial Sequence
  hemagglutinin__InfluenzaA__AFN87957
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFIDYEELREQLSSVSSFERFEIFPKTSSWPNHDPNKGVTAACPHAGAKSFYKNLIWLVKKGNSYPKLSTSYINDKGKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAFDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNKCMESVKNGTYDYPKYSEEAKLNREEIDGVKLESTRIYQILAIYSTVASSLVLVVSLGAISFWMCSNGSLQCRICI

SEQ ID NO: 9631 - protein, 566 aa, Artificial Sequence
  hemagglutinin__InfluenzaA__AFN87959
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9632 - protein, 566 aa, Artificial Sequence; identical to SEQ ID NO: 3154
  hemagglutinin__InfluenzaA__AFN87961

SEQ ID NO: 9633 - protein, 565 aa, Artificial Sequence
  hemagglutinin__InfluenzaA__AFO64802
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTVKNGLYPNLSKSYVNNKGKEVLVLWGVHHPSNIRDQRAIYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9634 - protein, 566 aa, Artificial Sequence
  hemagglutinin__InfluenzaA__AFO64813
MKAKLLVLLCAFTATDADTICIGYHANNSTDTVDTVLEKNVTVTHSVNLLEDSHNGKLCRLKGIAPLQLGNCSIAGWILGNPECESLFSKKSWSYIAETPNSENGTCYPGYFADYEELREQLSSVSSFERFEIFPKESSWPNHTVTKGVTASCSHKGRSSFYRNLLWLTEKNGSYPNLSKSYVNNKEKEVLVLWGVHHPSNIRDQRAIYHTENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9635 - protein, 566 aa, Artificial Sequence
  hemagglutinin__InfluenzaA__AFO64824
MKAILLVLLCAFTATDADTICIGYHANNSTDTVDTVLEKNVTVTHSVNLLEDSHNGKLCRLKGIAPLQLGNCSIAGWILGNPECESLFSKKSWSYIAETPNSENGTCYPGYFADYEELREQLSSVSSFERFEIFPKESSWPNHTVTKGVTASCSHKGRSSFYRNLLWLTEKNGLYPNLSKSYVNNKEKEVLVLWGVHHPSNIGDQRAIYHTENAYVSVVSSHYNRRFTPEIAKRPKVRGQEGRINYYWTLLEPGDTIIFEANGNLIAPWYAFALSRGFGSGIITSNASMDECDAKCQTPQGAINSSLPFQNVHPVTIGECPKYVRSTKLKMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9636 - protein, 566 aa, Artificial Sequence
  hemagglutinin__InfluenzaA__AFO64835
MKAKLLVLLCAFTATYADTICIGYHANNSTDTVDTVLEKNVTVTHSVNLLEDSHNGKLCRLKGIAPLQLGNCSVAGWILGNPECESLFSKESWSYIAETPDPENGTCYPGYFADYEELREQLSSVSSFERFEIFPKESSWPNHTVTKGVTASCSHNGKSSFYRNLLWLTKKNGLYPNLSKSYVNNKEKEVLVLWGVHHPSNIGEQRAIYHTENAYVSVVSSHYSRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9637 - protein, 566 aa, Artificial Sequence
  hemagglutinin__InfluenzaA__AFO64846
MKAKLLVLLCAFTATYADTICIGYHANNSTDTVDTVLEKNVTVTHSVNLLEDSHNGKLCRLKGIAPLQLGNCSVAGWILGNPECESLFTKESWSYIAETPNPENGTCYPGYFADYEELREQLSSVSSFERFEIFPKESSWPNHTVTKGVTASCSHNGKSSFYRNLLWLTEKNGLYPNLSKSYVNNKEKEVLVLWGVHHPSNMGDQRAIYHTENAYVSVVSSHYSRRFTPEIAKRPKVRGQEGRINYYWTLLEPGDTIIFEANGNLIAPRYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9638 - protein, 566 aa, Artificial Sequence
  hemagglutinin__InfluenzaA__AFO64857
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRGQEGRINYYWTLLEPGDTIIFEANGNLIAPWYAFALSRGFGSGIITSTASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENGRTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9639 - protein, 566 aa, Artificial Sequence
  hemagglutinin__InfluenzaA__AFO64868
MKVKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGCFADYEELREQLSSVSSFERFEIFPKESSWPNHTVTKGVTASCSHNGKSSFYKNLLWLTEKNGLYPNLSKSYVNNKEKEVLVLWGVHHPSNIRDQRAIYHTENAYVSVVSSHYSRRFTPEIAKRPKVRGQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9640 - protein, 565 aa, Artificial Sequence
  hemagglutinin__InfluenzaA__AFO64879
MKAKLLVLLCTFTATYADTICIGYHANNSTDTVDTVLEKNVTVTHSVNLLEDSHNGKLCLLKGIAPLQLGNCSVAGWILGNPECESLIFKESWSYIVETPNPENGTCYPGYFADYEELREQLSSVSSFERFEIFPKESSWPNHTVTGVSASCSHNGKSSFYRNLLWLTEKNGLYPNLSKSYVNNKEKEVLVLWGVHHPSNIRDQRAIYHTENAYVSVVSSHYSRRFTPEIAKRPKVRGQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9641 - protein, 565 aa, Artificial Sequence
  hemagglutinin__InfluenzaA__AFO64890
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTEKNGLYPNLSKSYVNNKEKEVLVLWGVHHPSNIRDQRAIYHTENAYVSVVSSHYSRRFTPEIAKRPKVRGQEGRINYYWTLLEPGDTIIFEANGNLIAPWYAFALSRGFGSGIITSNAPMDECDVKCQTPQGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9642 - protein, 566 aa, Artificial Sequence
  hemagglutinin__InfluenzaA__AFO64901
MKAKLLVLLCAFTATYADTICIGYHANNSTDTVDTVLEKNVTVTHSVNLLEDSHNGKLCRLKGTAPLQLGNCSIAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKKKEVLVLWGVHHPSNIGDQRAIYHTENAYVSVVSSHYSRRFTPEIAKRPKVRNQEGRINYYWTLLEPGDTIIFEANGNLIAPWYAFALSRGFESGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 9643 - protein, 565 aa, Artificial Sequence
  hemagglutinin__InfluenzaA__AFO65016
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTKKNGLYPNLSKSYVNNKEKEVLVLWGVHHPSNIGDQRTIYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPITIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNNLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9644 - protein, 565 aa, Artificial Sequence; identical to SEQ ID NO: 2115
  hemagglutinin__InfluenzaA__AFO65027

SEQ ID NO: 9645 - protein, 565 aa, Artificial Sequence
  hemagglutinin__InfluenzaA__AFO65038
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSMSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9646 - protein, 565 aa, Artificial Sequence
  hemagglutinin__InfluenzaA__AFO66136
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGNQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9647 - protein, 566 aa, Artificial Sequence
  hemagglutinin__InfluenzaA__AFO66147
MKAKLLVLLCAFTTTYADTICIGYHANNSTDTVDTVLEKNVTVTHSVNLLEDSHNGKLCRLKGTAPLQLGNCSIAGWILGNPECESLFSKESWSYIAETPNPKNGTCYPGYFADYEELREQLSSVSSFERFEIFPKDSSWPNHTVTKGVTASCSHNGKSSFYKNLLWLTGKNGLYPNLSKSYVNKKGKEVLVLWGVHHPSNMGDQRAIYHKENAYVSVLSSHYSRRFTPEIAKRPKVRDQEGRINYYWTLLEPGDTIIFEANGNLIAPWYAFALSRGFGSGIIISNASMGECDAKCQTPQGAINSSLPFQNVHPVTIGECPKYVRSTKLRMVTGLRNVPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 9648 - protein, 565 aa, Artificial Sequence
  hemagglutinin__InfluenzaA__AFO66158
MKAKLLVLLCTFTATYADTICIGYHANNSTDTVDTVLEKNVTVTHSVNLLEDSHNGKLCLLKGIAPLQLGNCSVAGWILGNPECELLISKGSWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9649 - protein, 565 aa, Artificial Sequence
  hemagglutinin__InfluenzaA__AFO66169
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETSNPENGTCYPGYFTDYEELREQLSSVSSFERFEIFPKESSWPNHTVTGVSASCSHNGKSSFYKNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPHGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 9650 - protein, 565 aa, Artificial Sequence
  hemagglutinin__InfluenzaA__AFO66180
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRNQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9651 - protein, 565 aa, Artificial Sequence
  hemagglutinin__InfluenzaA__AFO66191
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9652 - protein, 565 aa, Artificial Sequence; identical to SEQ ID NO: 512
  hemagglutinin__InfluenzaA__AFO66202

SEQ ID NO: 9653 - protein, 565 aa, Artificial Sequence
  hemagglutinin__InfluenzaA__AFO66213
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKKKEVLVLWGVHHPPNIGNQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 9654 - protein, 565 aa, Artificial Sequence
  hemagglutinin__InfluenzaA__AFO66224
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGNQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 9655 - protein, 565 aa, Artificial Sequence
  hemagglutinin__InfluenzaA__AFO66235
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGVQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 9656 - protein, 565 aa, Artificial Sequence
  hemagglutinin__InfluenzaA__AFO66246
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGNQRALYHTENAYVSVVSSHYSRKFTPEIAKRPKVRDQEGRINYYWTLLEPGDTIIFEANGNLIAPRYAFALSRGFGSGIINSNAPMDECDAECQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 9657 - protein, 566 aa, Artificial Sequence
  hemagglutinin__InfluenzaA__AFP33324
MKAKLLVLLCTFTATYADTICIGYHANNSTDTVDTVLEKNVTVTHSVNLLEDSHNGKLCRLKGTAPLQLGNCSIAGWILGNPECESLFSKESWSYIAETPNPKNGTCYPGYFADYEELREQLSSVSSFERFEIFPKDSSWPNHTVTKGVTASCSHNGKSSFYKNLLWLTGKNGLYPNLSKSYVNKKGKEVLVLWGVHHPSNMGDQRAIYHKENAYVSVLSSHYSRRFTPEIAKRPKVRDQEGRINYYWTLLEPGDTIIFEANGNLIAPWYAFALSRGFGSGIIISNASMGECDAKCQTPQGAINSSLPFQNVHPVTIGECPKYVRSTKLRMVTGLRNVPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 9658 - protein, 565 aa, Artificial Sequence
  hemagglutinin__InfluenzaA__AFP33325
MKVKLLVLLCTFTATYADTICIGYHANNSTDTVDTVLEKNVTVTHSVNLLEDSHNGKLCLLKGIAPLQLGNCSVAGWILGNPECELLIPKESWSYIVETPNPENGTCYPGYFADYEELREQLSSVSSFERFEIFPKESSWPSHTVTGVSASCSHNGKSSFYRNLLWLTGKNGLYPNLSKSYSNNKEKEVLVLWGVHHPPNIGDQRALYHTENAYVSVVSSHYSRRFTPEIAKRPKVRGQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 9659 - protein, 566 aa, Artificial Sequence
  hemagglutinin__InfluenzaA__AFQ32573
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVGDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9660 - protein, 566 aa, Artificial Sequence
  hemagglutinin__InfluenzaA__AFQ37281
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDREGRMNYYWTLVEPGDKITFEATGNLVVPRYAFAMERNAGSGIIISDTPAHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDDKCMESVKNGTYDYPKYSEEAKLNREEIDGVKLESTRIYQILAIYSTAASSLVLVVSLGAISFWMCSNGSLQCRICI

SEQ ID NO: 9661 - protein, 568 aa, Artificial Sequence
  hemagglutinin__InfluenzaA__AFQ55689
MNTQILALIACMLIGAKGDKICLGHHAVANGTKVNTLTERGIEVVNATETVETANTKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESIGVQSDVPLDSGCEGDCFHNGGTIVSSLPFQNINPRTVGKCPRYVKQTSLLLATGMRNVPENPKDRKSRHRRTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 9662 - protein, 566 aa, Artificial Sequence; identical to SEQ ID NO: 8186
  hemagglutinin__InfluenzaA__AFR68153

SEQ ID NO: 9663 - protein, 566 aa, Artificial Sequence
  hemagglutinin__InfluenzaA__AFR68163
MKATLVVLLYTFATANADTLCIGYHANNSTDTVDTVLEKNVTVTHSANLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 9664 - protein, 566 aa, Artificial Sequence
  hemagglutinin__InfluenzaA__AFR68173
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQASGRITVSTKRSQQSVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9665 - protein, 566 aa, Artificial Sequence; identical to SEQ ID NO: 2669
  hemagglutinin__InfluenzaA__AFR84675

SEQ ID NO: 9666 - protein, 566 aa, Artificial Sequence; identical to SEQ ID NO: 3022
  hemagglutinin__InfluenzaA__AFR84685

SEQ ID NO: 9667 - protein, 566 aa, Artificial Sequence; identical to SEQ ID NO: 2849
  hemagglutinin__InfluenzaA__AFR84694

SEQ ID NO: 9668 - protein, 566 aa, Artificial Sequence; identical to SEQ ID NO: 2656
  hemagglutinin__InfluenzaA__AFR84704

SEQ ID NO: 9669 - protein, 566 aa, Artificial Sequence
  hemagglutinin__InfluenzaA__AFR84714
MKAILVVLLYTFATANADTLCIGYRANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9670 - protein, 566 aa, Artificial Sequence; identical to SEQ ID NO: 2849
  hemagglutinin__InfluenzaA__AFR84724

SEQ ID NO: 9671 - protein, 566 aa, Artificial Sequence; identical to SEQ ID NO: 2849
  hemagglutinin__InfluenzaA__AFR84734

SEQ ID NO: 9672 - protein, 566 aa, Artificial Sequence; identical to SEQ ID NO: 2849
  hemagglutinin__InfluenzaA__AFR84754

SEQ ID NO: 9673 - protein, 566 aa, Artificial Sequence; identical to SEQ ID NO: 2849
  hemagglutinin__InfluenzaA__AFR84764

SEQ ID NO: 9674 - protein, 566 aa, Artificial Sequence; identical to SEQ ID NO: 2849
  hemagglutinin__InfluenzaA__AFR84774

SEQ ID NO: 9675 - protein, 566 aa, Artificial Sequence
  hemagglutinin__InfluenzaA__AFR84784
MKAILVGLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLALVVSLGAISFWMCSNGSLQCRICI

SEQ ID NO: 9676 - protein, 566 aa, Artificial Sequence; identical to SEQ ID NO: 2849
  hemagglutinin__InfluenzaA__AFR84794

SEQ ID NO: 9677 - protein, 566 aa, Artificial Sequence; identical to SEQ ID NO: 2669
  hemagglutinin__InfluenzaA__AFR84804

SEQ ID NO: 9678 - protein, 566 aa, Artificial Sequence; identical to SEQ ID NO: 2849
  hemagglutinin__InfluenzaA__AFR84814

SEQ ID NO: 9679 - protein, 566 aa, Artificial Sequence; identical to SEQ ID NO: 2669
  hemagglutinin__InfluenzaA__AFR84824

SEQ ID NO: 9680 - protein, 566 aa, Artificial Sequence; identical to SEQ ID NO: 2695
  hemagglutinin__InfluenzaA__AFR84834

SEQ ID NO: 9681 - protein, 566 aa, Artificial Sequence; identical to SEQ ID NO: 7869
  hemagglutinin__InfluenzaA__AFR84844

SEQ ID NO: 9682 - protein, 566 aa, Artificial Sequence; identical to SEQ ID NO: 2911
  hemagglutinin__InfluenzaA__AFR84854

SEQ ID NO: 9683 - protein, 566 aa, Artificial Sequence; identical to SEQ ID NO: 2669
  hemagglutinin__InfluenzaA__AFR84864

SEQ ID NO: 9684 - protein, 566 aa, Artificial Sequence; identical to SEQ ID NO: 2849
  hemagglutinin__InfluenzaA__AFR84874

SEQ ID NO: 9685 - protein, 566 aa, Artificial Sequence; identical to SEQ ID NO: 2656
  hemagglutinin__InfluenzaA__AFR84893

SEQ ID NO: 9686 - protein, 566 aa, Artificial Sequence; identical to SEQ ID NO: 2656
  hemagglutinin__InfluenzaA__AFR84903

SEQ ID NO: 9687 - protein, 566 aa, Artificial Sequence; identical to SEQ ID NO: 2656
  hemagglutinin__InfluenzaA__AFR84913

SEQ ID NO: 9688 - protein, 566 aa, Artificial Sequence; identical to SEQ ID NO: 2656
  hemagglutinin__InfluenzaA__AFR84923

SEQ ID NO: 9689 - protein, 562 aa, Artificial Sequence
  hemagglutinin__InfluenzaA__AFV53205
MAIIYLILLFATVRGDQICIGYHANNSTEKVDTILERNVTVTHAKDILEKTHNGKLCKLNGIPPLELGDCSIAGWLLGNPECDRLLRVPEWSYIMEKENPRYSLCYPGSLNDYEELKHLLSSVRHFEKVRILPKDRWTQHTTTGDSKACAVSGKPSFFRNMVWLTKKGPDYPVAKGSYNNTSGEQMLIIWGVHHPIDEAEQRELYQKVGTYVSASTSTLNKRSIPEIAARPEVNGLRSRMEFSWTLLDVWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDEITNKVNSVIEKMNTQFEAVGKEFNNLEKRLENLNKKMEDGFLDVWTYNAELLVLMENERTLDFHDSNVKNLYEKVRMQLRDNVKELGNGCFEFYHKCDDECINSVKNGTYDYPKYEEESKLKRNEIKGVKLSSMGVYQILAIYATVAGSLSLAIMMAGISFWMCSNGSLQCRICI

SEQ ID NO: 9690 - protein, 562 aa, Artificial Sequence
  hemagglutinin__InfluenzaA__AFV53216
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTEKGSNYPVAKGSYNNTSGEQMLIIWGVHHPNDETEQRTLYQNVGTYVSVGTSTLNKRSTPDIATRPKVNGQGGRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVEKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGIYQILAIYATVAGSLSLAIMMAGISFWMCSNGSLQCRICI

SEQ ID NO: 9691 - protein, 562 aa, Artificial Sequence
  hemagglutinin__InfluenzaA__AFV53227
MIIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDGWTQHKTDGGSKACAVSGKASFFRNMVWLTKEGPNYQVAKRSYNNTSGEQMLIIWGVHHPKDEAEQIALYQKVGTYVSASTSTLNKRSTPEIAARPEVNGLGSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDRITNKVNSVIEKMNIQFEAVGKEFSNLEKRLENLNKKMEDGFLDVWTYNAELLVLMENERTLDFHDSNVKNLYDKVRMQLRDNVKELGNGCFEFYHKCDDECMNSVKNGTYDYPKYEEESKLKRNEIKGVKLSSMGVYQILAIYATVAGSLSLAIMIAGISFWMCSNGSLQCRVCI

SEQ ID NO: 9692 - protein, 562 aa, Artificial Sequence
  hemagglutinin__InfluenzaA__AFV53238
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDRWTQHTTTGGSMACAVSGKPSFFRNMVWLTTKGPNYPVAQGSYNNTSGEQMLIIWGVHHPNDEAEQRALYQKVGTYVSASTSTLYKRSIPEIAARPKVNGLGSRMEFSWTLLDMWDTINFESTGNLVAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDNECMDSVKNGTYDYPKYEEESKLNRNEIKGVKLSSMGVYQILAIYATVAGSLSLAIMMAGISFWMCSNGSLQCRICI

SEQ ID NO: 9693 - protein, 562 aa, Artificial Sequence
  hemagglutinin__InfluenzaA__AFV53249
MAIIYLILLFATVRGDQICIGYHANNSTETVDTILERNVTVTHAKDILEKTHNGKLCKLNGIPPLELGDCSIAGWLLGNPECDRLLRVPEWSYIMEKENPRYSLCYPGSLNDYEELKHLLSSVKHFEKVRILPKDRWTNHTTTGGSKACAVSGEPSFFRNMVWLTKKGPNYPVAKGSYNNTSGEQMLIIWGVHHPNDEAEQRALYQKVGTYVSASTSTLYKRSIPEIAARPKVNGLGSRMEFSWTLLNVWDTINFESTGNLVAPEYGFKISKRGRSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFNNLEKRLENLNKKMEDGFLDVWTYNAELLVLMENERTLDFHDSNVKNLYEKVRMQLRDNVKELGNGCFEFYHKCDDECMNSVKNGTYDYPKYEEESKLKRNEIKGVKLSSMGVYQILAIYATVAGSLSLAIMVAGISFWMCSNGSLQCRICI

SEQ ID NO: 9694 - protein, 565 aa, Artificial Sequence
  hemagglutinin__InfluenzaA__AFV53260
MKAKLLILLCALSATDADTICIGYHANNSTDTVDTVLEKNVTVTHSVNLLEDSHNGKLCRLKGKAPLQLGNCNIAGWVLGNPECESLLSNRSWSYIAETPNSENGTCYPGDFADYEELREQLSSVSSFERFEIFPKERSWPNHTTRGVTAACPHAMKSSFYKNLVWLTEANGSYPNLSRSYVNNQEKEVLVLWGVHHPSNIEDQRTLYRKDNAYVSVVSSNYNRRFTPEIAKRPKVRGQSGRINYYWTLLEPGDTIIFEATGNLIAPWYAFALSRGPGSGIITSNAPLDECDTKCQTPQGAINSSLPFQNIHPVTIGECPKYVRSTKLRMVTGLRNIPSFQSRGLFGAIAGFIEGGWTGMMDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKELGNGCFEFYHKCDNECMESVKNGTYDYPKYSEESKLNREKIDGVKLESMGVYRILAIYSTVASSLVLLVSLGAISFWMCSNGSLQCRICI

SEQ ID NO: 9695 - protein, 562 aa, Artificial Sequence
  hemagglutinin__InfluenzaA__AFV53271
MAITYLILLFTAVRGDQICIGYHANNSTEKVDTILERNVTVTHAKDILEKTHNGKLCKLNGIPPLELGDCSIAGWLLGNPECDRFLRVPEWSYIMEKENPRYSLCYPGSFNDYEELKHLLSSVKHFEKVKILPKDGWTQHTTTGGSMACAVSGKPSFFRNMVWLTEKGQNYPVAKGSYNNTSGEQMLIIWGVHHPNDEAEQRALYQKVGTYVSASTSTLNKRSTPEIAARPKVNGLGSRMEFSWTLLDMWDTINFESTGNLVAPEYGFKISKRGSSGIMKTEGTLENCETKCQTPLGAINTTLPFHNVHPLTIGECPKYVKSEKLVLATGLRNIPQIESRGLFGAIAGFIEGGWQGMVDGWYGYHHSNDQGSGYAADKESTQKAFDGITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDNECMDSVKNGTYDYPKYEEESKLNRNEIKGVKLSSMGVYQILAIYATVAGSLSLAIMMAGISFWMCSNGSLQCRICI

SEQ ID NO: 9696 - protein, 562 aa, Artificial Sequence
  hemagglutinin__InfluenzaA__AFV53282
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGTNYPVAKGSYNNTSGEQMLIIWGVHHPNDETEQRTLYQNVGTYVSVGTSTLNKRSTPEIATRPKVNGLGSRMEFSWTLLDMWDTINFESTGNLIAPEYGFKISKRGSSGIMKTEGTLENCETKCQTPLGAINTTLPFHNVHPLTIGECPKYVKLEKLVLATGLRNVPQIESRGLFGAIAGFIEGGWQGMVDGWYGYHHSNDQGSGYAADKESTQKAFDVITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 9697 - protein, 562 aa, Artificial Sequence
  hemagglutinin__InfluenzaA__AFV53293
MAIIYLILLFTSVRGDQICIGYHANNSTEKVDTILERNVTVTHAKNILEKTHNGKLCKLNGIPPLELGDCSIAGWLLGNPECDRLLRVPEWSYIMEKENPKYSLCYPGSFNDYEELKHLLSSVKHFEKVKILPKDGWTQHTTNGGSRACAVSGNPSFFRNMVWLTKKGPNYPVAKGSYNNTSGEQMLIIWGVHHPNDEAEQRALYQEVGTYVSASTSTLNKRSTPEIAARPKVNGLGSRMEFSWTLLDMWDTINFESTGNLVAPEYGFKISKRGSSGVMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDDECMDSVKNGTYDYPKYEEESKLNRNEIKGVKLSSMGVYQILAIYATVAGSLSLAIMMAGISFWMCSNGSLQCRICI

SEQ ID NO: 9698 - protein, 562 aa, Artificial Sequence
  hemagglutinin__InfluenzaA__AFV53304
MAIIYLILLFTAVRGDQICIGYHANNSTEKVDTILEQNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKESNYPVAKGSYNNTSGEQMLIIWGVHHPNDETEQRTLYQNVGTYVSVGTSTLNKRSTPNIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 9699 - protein, 562 aa, Artificial Sequence
  hemagglutinin__InfluenzaA__AFV53314
MAIIYLILLFTAVRGDKICIGYHANNSTETVDTILERNVTVTHAKDILEKTHNGKLCKLNGIPPLELGDCSIAGWLLGNPECDRLLSVPEWSYIMEKENPRNGLCYPGNFNDYEELKHLLSSVKHFEKVKILPKDRWTQHTTTGGSQACAVSGNPSFFRNMVWLTEKESNYPVAKGSYNNTSGEQMLIIWGVHHPIDETEQRTLYQNVGTYVSVGTSTLNKRSTPEIAKRPKVNGLGSRMEFSWTLLDMWDTITFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNAVIEKINTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 9700 - protein, 562 aa, Artificial Sequence
  hemagglutinin__InfluenzaA__AFV53325
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYTVAKGSYNNTSGEQMLIIWGVHHPNDETEQRTLYQNVGTYVSVSTSTLNKRSTPEIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 9701 - protein, 562 aa, Artificial Sequence
  hemagglutinin__InfluenzaA__AFV53336
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHLEKVKILPKDGWTQHETDGGSKACAVSGKPSFFRNMVWLTKKGPNYPVAKRSYNNTSGEQMLIIWGVHHPNDEAEQRALYQKVGTYVSASTSTLNKRSTPEIAARPEVSGLGSRMEFSWTLLDVWDTISFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDRITNKVNSVIEKMNTQFEAVGKEFSNLEKRLENLNKKMEDGFLDVWTYNAELLVLMENERILDFHDSNVKNLYDKVRMQLRDNVKELGNGCFEFYHKCDDECMNSVKNGTYDYPKYEEESKLKRNEIKGVKLSSMGVYQILAIYATVAGSLSLAIMIAGISFWMCSNGSLQCRICI

SEQ ID NO: 9702 - protein, 566 aa, Artificial Sequence
  hemagglutinin__InfluenzaA__AFV68720
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSDSSFFSRLNWLTHLNFKYPALNVTMPNNEQFDKLYIWGVHHPGTDKDQIFLYAQASGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9703 - protein, 566 aa, Artificial Sequence; identical to SEQ ID NO: 2669
  hemagglutinin__InfluenzaA__AFX96347

SEQ ID NO: 9704 - protein, 566 aa, Artificial Sequence
  hemagglutinin__InfluenzaA__AFX96359
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 9705 - protein, 566 aa, Artificial Sequence
  hemagglutinin__InfluenzaA__AFX96366
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDRGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNQLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9706 - protein, 566 aa, Artificial Sequence; identical to SEQ ID NO: 4169
  hemagglutinin__InfluenzaA__AFX96383

SEQ ID NO: 9707 - protein, 566 aa, Artificial Sequence; identical to SEQ ID NO: 2669
  hemagglutinin__InfluenzaA__AFX96398

SEQ ID NO: 9708 - protein, 566 aa, Artificial Sequence; identical to SEQ ID NO: 2669
  hemagglutinin__InfluenzaA__AFX96408

SEQ ID NO: 9709 - protein, 566 aa, Artificial Sequence; identical to SEQ ID NO: 2669
  hemagglutinin__InfluenzaA__AFX96418

SEQ ID NO: 9710 - protein, 566 aa, Artificial Sequence; identical to SEQ ID NO: 2669
  hemagglutinin__InfluenzaA__AFX96428

SEQ ID NO: 9711 - protein, 566 aa, Artificial Sequence; identical to SEQ ID NO: 2669
  hemagglutinin__InfluenzaA__AFX96438

SEQ ID NO: 9712 - protein, 566 aa, Artificial Sequence; identical to SEQ ID NO: 2669
  hemagglutinin__InfluenzaA__AFX96448

SEQ ID NO: 9713 - protein, 566 aa, Artificial Sequence; identical to SEQ ID NO: 2669
  hemagglutinin__InfluenzaA__AFX96458

SEQ ID NO: 9714 - protein, 566 aa, Artificial Sequence; identical to SEQ ID NO: 2669
  hemagglutinin__InfluenzaA__AFX96468

SEQ ID NO: 9715 - protein, 566 aa, Artificial Sequence; identical to SEQ ID NO: 2669
  hemagglutinin__InfluenzaA__AFX96478

SEQ ID NO: 9716 - protein, 566 aa, Artificial Sequence; identical to SEQ ID NO: 2669
  hemagglutinin__InfluenzaA__AFX96488

SEQ ID NO: 9717 - protein, 566 aa, Artificial Sequence
  hemagglutinin__InfluenzaA__AFX96498
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKISKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9718 - protein, 566 aa, Artificial Sequence; identical to SEQ ID NO: 2669
  hemagglutinin__InfluenzaA__AFX96508

SEQ ID NO: 9719 - protein, 566 aa, Artificial Sequence; identical to SEQ ID NO: 4169
  hemagglutinin__InfluenzaA__AFX96518

SEQ ID NO: 9720 - protein, 566 aa, Artificial Sequence; identical to SEQ ID NO: 2669
  hemagglutinin__InfluenzaA__AFX96528

SEQ ID NO: 9721 - protein, 566 aa, Artificial Sequence; identical to SEQ ID NO: 4169
  hemagglutinin__InfluenzaA__AFX96538

SEQ ID NO: 9722 - protein, 566 aa, Artificial Sequence
  hemagglutinin__InfluenzaA__AFX96548
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9723 - protein, 566 aa, Artificial Sequence; identical to SEQ ID NO: 2669
  hemagglutinin__InfluenzaA__AFX96558

SEQ ID NO: 9724 - protein, 566 aa, Artificial Sequence; identical to SEQ ID NO: 3829
  hemagglutinin__InfluenzaA__AFX96568

SEQ ID NO: 9725 - protein, 566 aa, Artificial Sequence; identical to SEQ ID NO: 3829
  hemagglutinin__InfluenzaA__AFX96578

SEQ ID NO: 9726 - protein, 566 aa, Artificial Sequence; identical to SEQ ID NO: 2669
  hemagglutinin__InfluenzaA__AFX96588

SEQ ID NO: 9727 - protein, 566 aa, Artificial Sequence; identical to SEQ ID NO: 2669
  hemagglutinin__InfluenzaA__AFX96598

SEQ ID NO: 9728 - protein, 566 aa, Artificial Sequence
  hemagglutinin__InfluenzaA__AFX96608
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTLASSLVLVVSLGAISFWMCSNGSLQCRICI

SEQ ID NO: 9729 - protein, 566 aa, Artificial Sequence; identical to SEQ ID NO: 2669
  hemagglutinin__InfluenzaA__AFX96618

SEQ ID NO: 9730 - protein, 566 aa, Artificial Sequence; identical to SEQ ID NO: 3829
  hemagglutinin__InfluenzaA__AFX96628

SEQ ID NO: 9731 - protein, 566 aa, Artificial Sequence
  hemagglutinin__InfluenzaA__AFX96638
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLVWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLMVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9732 - protein, 566 aa, Artificial Sequence; identical to SEQ ID NO: 2669
  hemagglutinin__InfluenzaA__AFX96648

SEQ ID NO: 9733 - protein, 566 aa, Artificial Sequence; identical to SEQ ID NO: 3829
  hemagglutinin__InfluenzaA__AFX96658

SEQ ID NO: 9734 - protein, 566 aa, Artificial Sequence
  hemagglutinin__InfluenzaA__AFX96668
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCSKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9735 - protein, 566 aa, Artificial Sequence
  hemagglutinin__InfluenzaA__AFX96678
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACSHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9736 - protein, 566 aa, Artificial Sequence
  hemagglutinin__InfluenzaA__AFX96688
MKAILVVLLYTFATANADTLCIGYHANNSTDTVDTVLEKNVTVTHSVNLLEDKHNGKLCKLRGVAPLHLGKCNIAGWILGNPDCESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNDGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9737 - protein, 566 aa, Artificial Sequence; identical to SEQ ID NO: 2669
  hemagglutinin__InfluenzaA__AFX96698

SEQ ID NO: 9738 - protein, 566 aa, Artificial Sequence
  hemagglutinin__InfluenzaA__AFX96718
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKISKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQKAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9739 - protein, 566 aa, Artificial Sequence; identical to SEQ ID NO: 9738
  hemagglutinin__InfluenzaA__AFX96728

SEQ ID NO: 9740 - protein, 566 aa, Artificial Sequence; identical to SEQ ID NO: 3139
  hemagglutinin__InfluenzaA__AFX96738

SEQ ID NO: 9741 - protein, 566 aa, Artificial Sequence
  hemagglutinin__InfluenzaA__AFX96748
MKAILVVLLYTIATANADTLCIGYHANNSTDTVDTVIEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9742 - protein, 566 aa, Artificial Sequence
  hemagglutinin__InfluenzaA__AFX96758
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9743 - protein, 566 aa, Artificial Sequence
  hemagglutinin__InfluenzaA__AFX96768
MKAILVVLLYTFATANADTLCIGYHANNSTDTVDTVLEKNVTVTHSVNLLEDKHNGKLCKLRGVAPLHLGKCNIAGWILGNPECESLSTAISWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTKIYQILAIYSTVASSLVLVVSLGAISFWMCSNGSLQCRICI

SEQ ID NO: 9744 - protein, 566 aa, Artificial Sequence
  hemagglutinin__InfluenzaA__AFX96778
MKAILVILLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9745 - protein, 566 aa, Artificial Sequence
  hemagglutinin__InfluenzaA__AFX96788
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9746 - protein, 566 aa, Artificial Sequence; identical to SEQ ID NO: 9745
  hemagglutinin__InfluenzaA__AFX96798

SEQ ID NO: 9747 - protein, 566 aa, Artificial Sequence; identical to SEQ ID NO: 3829
  hemagglutinin__InfluenzaA__AFX96808

SEQ ID NO: 9748 - protein, 566 aa, Artificial Sequence; identical to SEQ ID NO: 6909
  hemagglutinin__InfluenzaA__AFX96818

SEQ ID NO: 9749 - protein, 566 aa, Artificial Sequence; identical to SEQ ID NO: 9745
  hemagglutinin__InfluenzaA__AFX96828

SEQ ID NO: 9750 - protein, 566 aa, Artificial Sequence; identical to SEQ ID NO: 5266
  hemagglutinin__InfluenzaA__AFX96838

SEQ ID NO: 9751 - protein, 566 aa, Artificial Sequence
  hemagglutinin__InfluenzaA__AFX96856
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACTHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9752 - protein, 566 aa, Artificial Sequence; identical to SEQ ID NO: 9734
  hemagglutinin__InfluenzaA__AFX96904

SEQ ID NO: 9753 - protein, 566 aa, Artificial Sequence; identical to SEQ ID NO: 4169
  hemagglutinin__InfluenzaA__AFX96914

SEQ ID NO: 9754 - protein, 566 aa, Artificial Sequence
  hemagglutinin__InfluenzaA__AFX96924
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKRFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9755 - protein, 566 aa, Artificial Sequence; identical to SEQ ID NO: 2669
  hemagglutinin__InfluenzaA__AFX96934

SEQ ID NO: 9756 - protein, 566 aa, Artificial Sequence
  hemagglutinin__InfluenzaA__AFY24097
MKAILVVLLYTFATANADTLCIGYHADNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9757 - protein, 566 aa, Artificial Sequence; identical to SEQ ID NO: 630
  hemagglutinin__InfluenzaA__AFY24162

SEQ ID NO: 9758 - protein, 566 aa, Artificial Sequence
  hemagglutinin__InfluenzaA__AFY24195
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9759 - protein, 566 aa, Artificial Sequence; identical to SEQ ID NO: 185
  hemagglutinin__InfluenzaA__AFY24217

SEQ ID NO: 9760 - protein, 566 aa, Artificial Sequence
  hemagglutinin__InfluenzaA__AGB08294
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPQAGAKSFYKNLIWLVKKGNSYPKLIKSYINDKGKEVLVLWGIHHPSTSADQQSLYQNADAYVFVGTSKYSKKFKPEIAVRPKVRDQEGRMNYYWTLVEPGDKITFEATGNLLVPRYAFVMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPRYSEEAKLNREEIDGVKLESTRIYQILAIYSTVASSLVLVVSLGAISFWMCSNGSLQCRICI

SEQ ID NO: 9761 - protein, 566 aa, Artificial Sequence
  hemagglutinin__InfluenzaA__AGB08295
MKAILVVLLYTFATANADTLCIGYHANNSTDTVDTVIEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKRKEVLVLWGIHHPSTTADQQSLYQNADAYVFVGTSRYSKKFKPEIAIRPKVRDQEGRMNYYWTLVEPGDKITFEATGNLVVPRYAFAMERTAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9762 - protein, 566 aa, Artificial Sequence
  hemagglutinin__InfluenzaA__AGB08296
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRGQEGRMNYYWTLVEPGDKITFEATGNLVVPRYAFAMERTAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9763 - protein, 566 aa, Artificial Sequence
  hemagglutinin__InfluenzaA__AGB08297
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSESYINDKGKEVLVLWGIHHPSTTADQQSLYQNADAYVFVGTSRYSKKFKPEIAIRPKVRDQEGRMNYYWTLVEPGDKITFEATGNLVVPRYAFAMERTAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9764 - protein, 566 aa, Artificial Sequence
  hemagglutinin__InfluenzaA__AGB08298
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPRLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERTAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNQLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9765 - protein, 566 aa, Artificial Sequence
  hemagglutinin__InfluenzaA__AGB08301
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTVVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9766 - protein, 566 aa, Artificial Sequence
  hemagglutinin__InfluenzaA__AGB08343
MKTIIALSYIFCLVLAQDLPGNDNSTATLCLGHHAVPNGTLVKTITNDQIEVTNATELVQSSSTGRICNNPHRILDGINCTLIDALLGDPHCDGFQNKKWDLFVERSKAFSNCYPYDVPDYASLRSLVASSGTLEFINEGFNWTGVTQNGGSYACKRGPDNGFFSRLNWLYKSESTYPVLNVTMPNNDNFDKLYIWGVHHPSTDKEQTNLYVQASGRVTVSTKRSQQTIIPNVGSRPWVRGLSSRISIYWTIVKPGDILVINSNGNLIAPRGYFKIRNGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 9767 - protein, 566 aa, Artificial Sequence
  hemagglutinin__InfluenzaA__AGB08362
MKTIIALSYIFCLALGQDLPGNDNSTATLCLGHHAVPNGTLVKTITDDQIEVTNATELVQSSSTGKICNNPHRILDGINCTLIDALLGDPHCDVFQDETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFDKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 9768 - protein, 566 aa, Artificial Sequence; identical to SEQ ID NO: 6822
  hemagglutinin__InfluenzaA__AGB12986

SEQ ID NO: 9769 - protein, 566 aa, Artificial Sequence; identical to SEQ ID NO: 7086
  hemagglutinin__InfluenzaA__AGB13006

SEQ ID NO: 9770 - protein, 566 aa, Artificial Sequence
  hemagglutinin__InfluenzaA__AGB13016
MKAILVVLLYTIATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEAIGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESARVYQILAIYSTVASSLVLVVSLGAISFWMCSNGSLQCRICI

SEQ ID NO: 9771 - protein, 566 aa, Artificial Sequence; identical to SEQ ID NO: 6867
  hemagglutinin__InfluenzaA__AGB13026

SEQ ID NO: 9772 - protein, 566 aa, Artificial Sequence; identical to SEQ ID NO: 6809
  hemagglutinin__InfluenzaA__AGB13036

SEQ ID NO: 9773 - protein, 566 aa, Artificial Sequence
  hemagglutinin__InfluenzaA__AGB13048
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCIESVKNGTYDYPKYSEEAKLNREEIDGVKLESTRIYQILAIYSTVASSLVLVVSLGAISFWMCSNGSLQCRICI

SEQ ID NO: 9774 - protein, 566 aa, Artificial Sequence
  hemagglutinin__InfluenzaA__AGB13066
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKGTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9775 - protein, 566 aa, Artificial Sequence; identical to SEQ ID NO: 6909
  hemagglutinin__InfluenzaA__AGB13082

SEQ ID NO: 9776 - protein, 566 aa, Artificial Sequence; identical to SEQ ID NO: 6809
  hemagglutinin__InfluenzaA__AGB13105

SEQ ID NO: 9777 - protein, 566 aa, Artificial Sequence; identical to SEQ ID NO: 6867
  hemagglutinin__InfluenzaA__AGB13125

SEQ ID NO: 9778 - protein, 566 aa, Artificial Sequence; identical to SEQ ID NO: 6867
  hemagglutinin__InfluenzaA__AGB13130

SEQ ID NO: 9779 - protein, 566 aa, Artificial Sequence
  hemagglutinin__InfluenzaA__AGB13140
MKAILVVLLYTFATANADTLCIGYHANNSTDTVDTVLEKNVTVTHSVNLLEDKHNGKLCKLRGVAPLHLGKCNIAGWILGNPECESLSTASLWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9780 - protein, 566 aa, Artificial Sequence
  hemagglutinin__InfluenzaA__AGB13159
MKAILVVMLYTFATANADTLCIGYHANNSTDTVDTVLEKNVTVTHSVNLLEDKHNGKLCKLRGVASLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9781 - protein, 566 aa, Artificial Sequence; identical to SEQ ID NO: 6824
  hemagglutinin__InfluenzaA__AGB13170

SEQ ID NO: 9782 - protein, 566 aa, Artificial Sequence
  hemagglutinin__InfluenzaA__AGB13180
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9783 - protein, 566 aa, Artificial Sequence; identical to SEQ ID NO: 6867
  hemagglutinin__InfluenzaA__AGB13190

SEQ ID NO: 9784 - protein, 566 aa, Artificial Sequence
  hemagglutinin__InfluenzaA__AGB13200
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGVKSFYKNLIWLVKKGNSYPKLSKSYINDKGKEVLVLWGIHHPSTTTDQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9785 - protein, 566 aa, Artificial Sequence
  hemagglutinin__InfluenzaA__AGB13210
MKATLVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9786 - protein, 566 aa, Artificial Sequence
  hemagglutinin__InfluenzaA__AGB13220
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9787 - protein, 566 aa, Artificial Sequence
  hemagglutinin__InfluenzaA__AGB13230
MKAILVVLLYTFATANADTLCIGYHANNSTDTVDTVLEKNVTVTHSVNLLEDNHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNRLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9788 - protein, 566 aa, Artificial Sequence; identical to SEQ ID NO: 6867
  hemagglutinin__InfluenzaA__AGB13240

SEQ ID NO: 9789 - protein, 566 aa, Artificial Sequence; identical to SEQ ID NO: 6867
  hemagglutinin__InfluenzaA__AGB13250

SEQ ID NO: 9790 - protein, 566 aa, Artificial Sequence
  hemagglutinin__InfluenzaA__AGB13260
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGSKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESIKNGTYDYPKYSEEAKLNREEIDGVKLESTRIYQILAIYSTVASSLVLVVSLGAISFWMCSNGSLQCRICI

SEQ ID NO: 9791 - protein, 566 aa, Artificial Sequence
  hemagglutinin__InfluenzaA__AGB13270
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 9792 - protein, 566 aa, Artificial Sequence
  hemagglutinin__InfluenzaA__AGB13280
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTNADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNGQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9793 - protein, 566 aa, Artificial Sequence
  hemagglutinin__InfluenzaA__AGB13290
MKAILVVLLYTFATANADTLCIGYHANNSTDTVDTVLEKNVTVTHSVNLLEVKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9794 - protein, 566 aa, Artificial Sequence; identical to SEQ ID NO: 6867
  hemagglutinin__InfluenzaA__AGB13300

SEQ ID NO: 9795 - protein, 566 aa, Artificial Sequence
  hemagglutinin__InfluenzaA__AGB13310
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGVHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9796 - protein, 566 aa, Artificial Sequence
  hemagglutinin__InfluenzaA__AGB13320
MKAILVVLLYTIATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESARVYQILAIYSTVASSLVLVVSLGAISFWMCSNGSLQCRICI

SEQ ID NO: 9797 - protein, 566 aa, Artificial Sequence
  hemagglutinin__InfluenzaA__AGB13330
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYSNDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9798 - protein, 566 aa, Artificial Sequence; identical to SEQ ID NO: 6867
  hemagglutinin__InfluenzaA__AGB13340

SEQ ID NO: 9799 - protein, 566 aa, Artificial Sequence
  hemagglutinin__InfluenzaA__AGB13350
MKAILVVLLYTFATANADTLCIGYHANNSTETVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPQAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9800 - protein, 566 aa, Artificial Sequence
  hemagglutinin__InfluenzaA__AGB13360
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAEMLVLLENEKTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9801 - protein, 566 aa, Artificial Sequence
  hemagglutinin__InfluenzaA__AGB13380
MKAILVVLLYTFATAKADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNPGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9802 - protein, 566 aa, Artificial Sequence; identical to SEQ ID NO: 6435
  hemagglutinin__InfluenzaA__AGB13390

SEQ ID NO: 9803 - protein, 566 aa, Artificial Sequence; identical to SEQ ID NO: 7042
  hemagglutinin__InfluenzaA__AGB13400

SEQ ID NO: 9804 - protein, 566 aa, Artificial Sequence; identical to SEQ ID NO: 6435
  hemagglutinin__InfluenzaA__AGB13410

SEQ ID NO: 9805 - protein, 566 aa, Artificial Sequence; identical to SEQ ID NO: 6454
  hemagglutinin__InfluenzaA__AGB13420

SEQ ID NO: 9806 - protein, 566 aa, Artificial Sequence
  hemagglutinin__InfluenzaA__AGB13430
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTMIYQILAIYSTVASSLVLVVSLGAISFWMCSNGSLQCRICI

SEQ ID NO: 9807 - protein, 566 aa, Artificial Sequence; identical to SEQ ID NO: 7042
  hemagglutinin__InfluenzaA__AGB13440

SEQ ID NO: 9808 - protein, 566 aa, Artificial Sequence; identical to SEQ ID NO: 6454
  hemagglutinin__InfluenzaA__AGB13450

SEQ ID NO: 9809 - protein, 566 aa, Artificial Sequence; identical to SEQ ID NO: 6435
  hemagglutinin__InfluenzaA__AGB13460

SEQ ID NO: 9810 - protein, 566 aa, Artificial Sequence; identical to SEQ ID NO: 6867
  hemagglutinin__InfluenzaA__AGB13470

SEQ ID NO: 9811 - protein, 566 aa, Artificial Sequence; identical to SEQ ID NO: 6454
  hemagglutinin__InfluenzaA__AGB13480

SEQ ID NO: 9812 - protein, 566 aa, Artificial Sequence; identical to SEQ ID NO: 6867
  hemagglutinin__InfluenzaA__AGB13490

SEQ ID NO: 9813 - protein, 566 aa, Artificial Sequence
  hemagglutinin__InfluenzaA__AGB13500
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKGFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9814 - protein, 566 aa, Artificial Sequence; identical to SEQ ID NO: 7072
  hemagglutinin__InfluenzaA__AGB13520

SEQ ID NO: 9815 - protein, 566 aa, Artificial Sequence
  hemagglutinin__InfluenzaA__AGB13530
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 9816 - protein, 566 aa, Artificial Sequence; identical to SEQ ID NO: 7086
  hemagglutinin__InfluenzaA__AGB13540

SEQ ID NO: 9817 - protein, 566 aa, Artificial Sequence; identical to SEQ ID NO: 7050
  hemagglutinin__InfluenzaA__AGB13550

SEQ ID NO: 9818 - protein, 566 aa, Artificial Sequence; identical to SEQ ID NO: 7050
  hemagglutinin__InfluenzaA__AGB13560

SEQ ID NO: 9819 - protein, 566 aa, Artificial Sequence; identical to SEQ ID NO: 6867
  hemagglutinin__InfluenzaA__AGB13570

SEQ ID NO: 9820 - protein, 566 aa, Artificial Sequence
  hemagglutinin__InfluenzaA__AGB13580
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCNNTCMESVKNGTYDYPKYSEEAKLNREEIDGVKLESTRIYQILAIYSTVASSLVLVVSLGAISFWMCSNGSLQCRICI

SEQ ID NO: 9821 - protein, 566 aa, Artificial Sequence
  hemagglutinin__InfluenzaA__AGB13590
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9822 - protein, 566 aa, Artificial Sequence
  hemagglutinin__InfluenzaA__AGB13600
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLNKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9823 - protein, 566 aa, Artificial Sequence; identical to SEQ ID NO: 6867
  hemagglutinin__InfluenzaA__AGB13610

SEQ ID NO: 9824 - protein, 566 aa, Artificial Sequence; identical to SEQ ID NO: 7086
  hemagglutinin__InfluenzaA__AGB13620

SEQ ID NO: 9825 - protein, 566 aa, Artificial Sequence; identical to SEQ ID NO: 6454
  hemagglutinin__InfluenzaA__AGB13630

SEQ ID NO: 9826 - protein, 566 aa, Artificial Sequence
  hemagglutinin__InfluenzaA__AGB13640
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTMIYQILAIYSTVASSLVLIVSLGAISFWMCSNGSLQCRICI

SEQ ID NO: 9827 - protein, 566 aa, Artificial Sequence
  hemagglutinin__InfluenzaA__AGB13650
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLILLENERTLDYHDSNVKNLYEKVRSQLKNNAKEIGNGCFEFYHKCDNTCMESVKNGTYDYPKYSEEAKLNREEIDGVKLESTMIYQILAIYSTVASSLVLIVSLGAISFWMCSNGSLQCRICI

SEQ ID NO: 9828 - protein, 566 aa, Artificial Sequence; identical to SEQ ID NO: 6824
  hemagglutinin__InfluenzaA__AGB13660

SEQ ID NO: 9829 - protein, 566 aa, Artificial Sequence; identical to SEQ ID NO: 6435
  hemagglutinin__InfluenzaA__AGB13721

SEQ ID NO: 9830 - protein, 566 aa, Artificial Sequence; identical to SEQ ID NO: 6867
  hemagglutinin__InfluenzaA__AGB13731

SEQ ID NO: 9831 - protein, 566 aa, Artificial Sequence
  hemagglutinin__InfluenzaA__AGB51356
MKAILLVLLCTFAATNADTLCIGYHANNSTDTVDTVLEKNVTVTHSVNLLEDRHNGKLCKLGGIAPLHLGKCNIAGWLLGNPECELLLTVSSWSYIVETSNSDNGTCYPGDFINYEELREQLSSVSSFERFEIFPKTSSWPNHETNRGVTAACPYAGANSFYRNLIWLVEKGNSYPKLSKSYVNNKGKEVLVLWGIHHPPTSTDQQSLYQNADAYVFVGSSKYNRKFKPEIAARPKVRGQAGRMNYYWTLIEPGDTITFEATGNLVVPRYAFAMNRGSGSGIIISDAPVHDCNTKCQTPKGAINTSLPFQNIHPVTIGECPKYVKSTKLRMATGLRNIPSIQSRGLFGAIAGFIEGGWTGMIDGWYGYHHQNEQGSGYAADQRSTQNAIDGITNKVNSVIEKMNTQFTAVGKEFNHLEKRIENLNKKVDDGFLDIWTYNAELLVLLENERTLDFHDSNVKNLYEKVRSQLRNNAKEIGNGCFEFYHKCDDTCMESVKNGTYDYPKYSEESKLNREEIDGVKLESTRIYQILAIYSTVASSLVLLVSLGAISFWMCSNGSLQCRICI

SEQ ID NO: 9832 - protein, 566 aa, Artificial Sequence
  hemagglutinin__InfluenzaA__AGB97269
MKAILVVLLYTFATANADTLCIGYHANNSTDTVDTVLEKNITVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 9833 - protein, 566 aa, Artificial Sequence; identical to SEQ ID NO: 8186
  hemagglutinin__InfluenzaA__AGB97273

SEQ ID NO: 9834 - protein, 566 aa, Artificial Sequence
  hemagglutinin__InfluenzaA__AGB97288
MKTIIALGYILCLVFAQKLPGNDNSTATLCLGHHAVPNGTIVKTITNDRIEVTNATELVQNSSIGEICDSPHQILDGKNCTLIDALLGDPQCDGFQNKKWDLFIERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAKSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9835 - protein, 566 aa, Artificial Sequence
  hemagglutinin__InfluenzaA__AGB97292
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9836 - protein, 566 aa, Artificial Sequence
  hemagglutinin__InfluenzaA__AGB97300
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9837 - protein, 566 aa, Artificial Sequence
  hemagglutinin__InfluenzaA__AGE89267
MKAILIVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGEKSFYKNLIWLVKKGNSYPKLNKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 9838 - protein, 566 aa, Artificial Sequence
  hemagglutinin__InfluenzaA__AGE89277
MKAILIVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLNSVSSFERFEIFPKTSSWPNHDSNKGVTAACPHAGEKSFYKNLIWLVKKGNSYPKLNKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 9839 - protein, 566 aa, Artificial Sequence; identical to SEQ ID NO: 8356
  hemagglutinin__InfluenzaA__AGE89287

SEQ ID NO: 9840 - protein, 566 aa, Artificial Sequence
  hemagglutinin__InfluenzaA__AGE89298
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLILVVSLGAISFWMCSNGSLQCRICI

SEQ ID NO: 9841 - protein, 566 aa, Artificial Sequence; identical to SEQ ID NO: 6909
  hemagglutinin__InfluenzaA__AGE89308

SEQ ID NO: 9842 - protein, 566 aa, Artificial Sequence; identical to SEQ ID NO: 8351
  hemagglutinin__InfluenzaA__AGE89318

SEQ ID NO: 9843 - protein, 566 aa, Artificial Sequence
  hemagglutinin__InfluenzaA__AGE89329
MKTIIALSYILCLVFAQKLPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9844 - protein, 566 aa, Artificial Sequence; identical to SEQ ID NO: 6454
  hemagglutinin__InfluenzaA__AGE89340

SEQ ID NO: 9845 - protein, 566 aa, Artificial Sequence; identical to SEQ ID NO: 8354
  hemagglutinin__InfluenzaA__AGE89350

SEQ ID NO: 9846 - protein, 566 aa, Artificial Sequence
  hemagglutinin__InfluenzaA__AGE89361
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9847 - protein, 566 aa, Artificial Sequence; identical to SEQ ID NO: 8351
  hemagglutinin__InfluenzaA__AGE89371

SEQ ID NO: 9848 - protein, 566 aa, Artificial Sequence
  hemagglutinin__InfluenzaA__AGE89382
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVKPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9849 - protein, 566 aa, Artificial Sequence
  hemagglutinin__InfluenzaA__AGE89392
MKTIIALSYILCLVFAQELPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9850 - protein, 566 aa, Artificial Sequence; identical to SEQ ID NO: 9837
  hemagglutinin__InfluenzaA__AGE89422

SEQ ID NO: 9851 - protein, 566 aa, Artificial Sequence; identical to SEQ ID NO: 8334
  hemagglutinin__InfluenzaA__AGE89719

SEQ ID NO: 9852 - protein, 566 aa, Artificial Sequence
  hemagglutinin__InfluenzaA__AGE89730
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNGQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9853 - protein, 566 aa, Artificial Sequence; identical to SEQ ID NO: 8351
  hemagglutinin__InfluenzaA__AGE89740

SEQ ID NO: 9854 - protein, 566 aa, Artificial Sequence
  hemagglutinin__InfluenzaA__AGE89751
MKTIIALSYILCLVFAQKLPGNDNSTATLCLGHHAVPNGTIVKTITNDQIEVTNATELVQSSSAGEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVAMENQHTIDLTDSEMNKLFEKTKKQLRENAEDMGNGCFKIYHKCDNACIGSIRNGTYDHDVYRDEALSNRFQIKGVELKSGYKDWILWISFAISCFLLCVALLGFIMWACQKGNIRCNICI

SEQ ID NO: 9855 - protein, 566 aa, Artificial Sequence; identical to SEQ ID NO: 8354
  hemagglutinin__InfluenzaA__AGE89762

SEQ ID NO: 9856 - protein, 566 aa, Artificial Sequence
  hemagglutinin__InfluenzaA__AGF44891
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAVDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 9857 - protein, 566 aa, Artificial Sequence; identical to SEQ ID NO: 9856
  hemagglutinin__InfluenzaA__AGF44892

SEQ ID NO: 9858 - protein, 566 aa, Artificial Sequence
  hemagglutinin__InfluenzaA__AGF44895
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9859 - protein, 566 aa, Artificial Sequence; identical to SEQ ID NO: 9835
  hemagglutinin__InfluenzaA__AGF44896

SEQ ID NO: 9860 - protein, 566 aa, Artificial Sequence
  hemagglutinin__InfluenzaA__AGF44897
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACMRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIQSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9861 - protein, 566 aa, Artificial Sequence; identical to SEQ ID NO: 9858
  hemagglutinin__InfluenzaA__AGF44900

SEQ ID NO: 9862 - protein, 566 aa, Artificial Sequence; identical to SEQ ID NO: 9858
  hemagglutinin__InfluenzaA__AGF44901

SEQ ID NO: 9863 - protein, 566 aa, Artificial Sequence; identical to SEQ ID NO: 9858
  hemagglutinin__InfluenzaA__AGF44902

SEQ ID NO: 9864 - protein, 566 aa, Artificial Sequence; identical to SEQ ID NO: 9858
  hemagglutinin__InfluenzaA__AGF44903

SEQ ID NO: 9865 - protein, 566 aa, Artificial Sequence; identical to SEQ ID NO: 9858
  hemagglutinin__InfluenzaA__AGF44904

SEQ ID NO: 9866 - protein, 566 aa, Artificial Sequence
  hemagglutinin__InfluenzaA__AGF44905
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRNTYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9867 - protein, 566 aa, Artificial Sequence; identical to SEQ ID NO: 9858
  hemagglutinin__InfluenzaA__AGF44906

SEQ ID NO: 9868 - protein, 566 aa, Artificial Sequence
  hemagglutinin__InfluenzaA__AGF44908
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9869 - protein, 566 aa, Artificial Sequence; identical to SEQ ID NO: 9858
  hemagglutinin__InfluenzaA__AGF44909

SEQ ID NO: 9870 - protein, 566 aa, Artificial Sequence; identical to SEQ ID NO: 9858
  hemagglutinin__InfluenzaA__AGF44910

SEQ ID NO: 9871 - protein, 566 aa, Artificial Sequence
  hemagglutinin__InfluenzaA__AGF44911
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFATSCFLLCVALLGFIMWACQKGNIRCNICI

SEQ ID NO: 9872 - protein, 566 aa, Artificial Sequence; identical to SEQ ID NO: 9858
  hemagglutinin__InfluenzaA__AGF44912

SEQ ID NO: 9873 - protein, 566 aa, Artificial Sequence; identical to SEQ ID NO: 9858
  hemagglutinin__InfluenzaA__AGF44913

SEQ ID NO: 9874 - protein, 566 aa, Artificial Sequence
  hemagglutinin__InfluenzaA__AGF44914
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNKITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9875 - protein, 566 aa, Artificial Sequence; identical to SEQ ID NO: 9835
  hemagglutinin__InfluenzaA__AGF44916

SEQ ID NO: 9876 - protein, 566 aa, Artificial Sequence
  hemagglutinin__InfluenzaA__AGF44917
MKTIIALSYILCLVFAQKIPGNDNSTATLCLGHHAVPNGTIVKTITNEQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRGSDSSFFSRLNWLTHLNFKYPALNVTMPNNEQFDKLYIWGVHHPGTDKDQIFLYAQASGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9877 - protein, 566 aa, Artificial Sequence; identical to SEQ ID NO: 9835
  hemagglutinin__InfluenzaA__AGF44918

SEQ ID NO: 9878 - protein, 566 aa, Artificial Sequence
  hemagglutinin__InfluenzaA__AGF44919
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHYVYRDEALNNRFQIKGVELKSGYKDWILWISFAISCFLLCVALLGFIMWACQKGNIRCNICI

SEQ ID NO: 9879 - protein, 566 aa, Artificial Sequence; identical to SEQ ID NO: 9835
  hemagglutinin__InfluenzaA__AGF44920

SEQ ID NO: 9880 - protein, 566 aa, Artificial Sequence; identical to SEQ ID NO: 9858
  hemagglutinin__InfluenzaA__AGF44921

SEQ ID NO: 9881 - protein, 566 aa, Artificial Sequence
  hemagglutinin__InfluenzaA__AGG13411
MKTIIALSYILCLVFAQELPGNDDSTATLCLGHHAVPNGTIVKTITNDRIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRNQQTVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9882 - protein, 566 aa, Artificial Sequence
  hemagglutinin__InfluenzaA__AGG13447
MKTIIALSYILCLVFAQELPGNDDSTATLCLGHHAVPNGTIVKTITNDRIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQTVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTQKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9883 - protein, 566 aa, Artificial Sequence
  hemagglutinin__InfluenzaA__AGG13459
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9884 - protein, 566 aa, Artificial Sequence
  hemagglutinin__InfluenzaA__AGG13495
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSDSSFFSRLNWLTHLNFKYPALNVTMPNNEQFDKLYIWGVHHPGTDKDQIFLYAQASGRITVSTKRSQQSVIPNIGSRPRIRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9885 - protein, 566 aa, Artificial Sequence; identical to SEQ ID NO: 9883
  hemagglutinin__InfluenzaA__AGG13507

SEQ ID NO: 9886 - protein, 566 aa, Artificial Sequence
  hemagglutinin__InfluenzaA__AGG13519
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSDSSFFSRLNWLTHLNFKYPALNVTMPNNEQFDKLYIWGVHHPGTDKDQIFLYAQASGRITVSTKRSQQSVIPNIGSRPRIRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRVQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9887 - protein, 566 aa, Artificial Sequence; identical to SEQ ID NO: 9883
  hemagglutinin__InfluenzaA__AGG13531

SEQ ID NO: 9888 - protein, 566 aa, Artificial Sequence
  hemagglutinin__InfluenzaA__AGG13543
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDIEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9889 - protein, 566 aa, Artificial Sequence; identical to SEQ ID NO: 9883
  hemagglutinin__InfluenzaA__AGG13555

SEQ ID NO: 9890 - protein, 566 aa, Artificial Sequence; identical to SEQ ID NO: 9883
  hemagglutinin__InfluenzaA__AGG13567

SEQ ID NO: 9891 - protein, 566 aa, Artificial Sequence
  hemagglutinin__InfluenzaA__AGG13591
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNENFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDRPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9892 - protein, 566 aa, Artificial Sequence
  hemagglutinin__InfluenzaA__AGG13615
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPSDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9893 - protein, 566 aa, Artificial Sequence; identical to SEQ ID NO: 9891
  hemagglutinin__InfluenzaA__AGG13627

SEQ ID NO: 9894 - protein, 566 aa, Artificial Sequence
  hemagglutinin__InfluenzaA__AGG13639
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTNKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9895 - protein, 566 aa, Artificial Sequence; identical to SEQ ID NO: 9884
  hemagglutinin__InfluenzaA__AGG13651

SEQ ID NO: 9896 - protein, 566 aa, Artificial Sequence; identical to SEQ ID NO: 9883
  hemagglutinin__InfluenzaA__AGG13663

SEQ ID NO: 9897 - protein, 566 aa, Artificial Sequence; identical to SEQ ID NO: 9884
  hemagglutinin__InfluenzaA__AGG13675

SEQ ID NO: 9898 - protein, 566 aa, Artificial Sequence; identical to SEQ ID NO: 9883
  hemagglutinin__InfluenzaA__AGG13687

SEQ ID NO: 9899 - protein, 566 aa, Artificial Sequence; identical to SEQ ID NO: 9884
  hemagglutinin__InfluenzaA__AGG13711

SEQ ID NO: 9900 - protein, 566 aa, Artificial Sequence; identical to SEQ ID NO: 9883
  hemagglutinin__InfluenzaA__AGG13723

SEQ ID NO: 9901 - protein, 566 aa, Artificial Sequence; identical to SEQ ID NO: 9883
  hemagglutinin__InfluenzaA__AGG13735

SEQ ID NO: 9902 - protein, 566 aa, Artificial Sequence; identical to SEQ ID NO: 9883
  hemagglutinin__InfluenzaA__AGG13747

SEQ ID NO: 9903 - protein, 566 aa, Artificial Sequence
  hemagglutinin__InfluenzaA__AGG13759
MKTIIALSYILCLVFAQELPGNDDSTATLCLGHHAVPNGTIVKTITNDRIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQTVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9904 - protein, 566 aa, Artificial Sequence
  hemagglutinin__InfluenzaA__AGG13771
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSDSSFFSRLNWLTHLNFKYPALNVTMPNNEQFDKLYIWGVHHPGTDKDQIFLYAQASGRITVSTKRSQQSVIPNIGSRPRIRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDNKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9905 - protein, 566 aa, Artificial Sequence
  hemagglutinin__InfluenzaA__AGG13783
MKTIIALSYILCLVFAQKLPGNDNSTATLCLGHHAVPNGTIVKTITNDQIEVTNATELVQNSSMGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNVPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9906 - protein, 566 aa, Artificial Sequence; identical to SEQ ID NO: 9884
  hemagglutinin__InfluenzaA__AGG13795

SEQ ID NO: 9907 - protein, 566 aa, Artificial Sequence; identical to SEQ ID NO: 9835
  hemagglutinin__InfluenzaA__AGG13807

SEQ ID NO: 9908 - protein, 566 aa, Artificial Sequence; identical to SEQ ID NO: 9884
  hemagglutinin__InfluenzaA__AGG13819

SEQ ID NO: 9909 - protein, 566 aa, Artificial Sequence; identical to SEQ ID NO: 9884
  hemagglutinin__InfluenzaA__AGG13831

SEQ ID NO: 9910 - protein, 566 aa, Artificial Sequence; identical to SEQ ID NO: 9883
  hemagglutinin__InfluenzaA__AGG13855

SEQ ID NO: 9911 - protein, 566 aa, Artificial Sequence
  hemagglutinin__InfluenzaA__AGG13867
MKTIIALSYILCLVFAQKLPGNDNSTATLCLGHHAVPNGTIVKTITNDRIEVTNATELVQNSSIGKICDSPHQILDGENCTLMDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 9912 - protein, 566 aa, Artificial Sequence; identical to SEQ ID NO: 9883
  hemagglutinin__InfluenzaA__AGG13879

SEQ ID NO: 9913 - protein, 566 aa, Artificial Sequence; identical to SEQ ID NO: 9883
  hemagglutinin__InfluenzaA__AGG13891

SEQ ID NO: 9914 - protein, 566 aa, Artificial Sequence
  hemagglutinin__InfluenzaA__AGG13903
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSDSSFFSRLNWLTHLNFKYPALNVTMPNNEQFDKLYIWGVHHPGTDKDQIFLYAQASGRITVSTKRSQQSVLPNIGSRPRIRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9915 - protein, 566 aa, Artificial Sequence; identical to SEQ ID NO: 9883
  hemagglutinin__InfluenzaA__AGG13927

SEQ ID NO: 9916 - protein, 566 aa, Artificial Sequence; identical to SEQ ID NO: 9891
  hemagglutinin__InfluenzaA__AGG13939

SEQ ID NO: 9917 - protein, 566 aa, Artificial Sequence
  hemagglutinin__InfluenzaA__AGG13962
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFEGFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAESGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 9918 - protein, 566 aa, Artificial Sequence; identical to SEQ ID NO: 9883
  hemagglutinin__InfluenzaA__AGG13973

SEQ ID NO: 9919 - protein, 566 aa, Artificial Sequence; identical to SEQ ID NO: 9883
  hemagglutinin__InfluenzaA__AGG13985

SEQ ID NO: 9920 - protein, 566 aa, Artificial Sequence; identical to SEQ ID NO: 9883
  hemagglutinin__InfluenzaA__AGG13997

SEQ ID NO: 9921 - protein, 566 aa, Artificial Sequence; identical to SEQ ID NO: 9883
  hemagglutinin__InfluenzaA__AGG14009

SEQ ID NO: 9922 - protein, 566 aa, Artificial Sequence
  hemagglutinin__InfluenzaA__AGG14021
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGIELKSGYKDWILWISFAISCFLLCVALLGFIMWACQKGNIRCNICI

SEQ ID NO: 9923 - protein, 566 aa, Artificial Sequence; identical to SEQ ID NO: 9884
  hemagglutinin__InfluenzaA__AGG14033

SEQ ID NO: 9924 - protein, 566 aa, Artificial Sequence; identical to SEQ ID NO: 9903
  hemagglutinin__InfluenzaA__AGG14318

SEQ ID NO: 9925 - protein, 566 aa, Artificial Sequence
  hemagglutinin__InfluenzaA__AGG14330
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIIRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9926 - protein, 566 aa, Artificial Sequence
  hemagglutinin__InfluenzaA__AGG84179
MKTIIALSYILCLVFAQKLPGNDNSTATLCLGHHAVPNGTIVKTITNDQIEVTNATELVQSSSASEICDSPHHILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9927 - protein, 567 aa, Artificial Sequence
  hemagglutinin__InfluenzaA__AGI02564
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGNFNDYEELKHLLSRINHFEKIQIIPKSSWSGHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRNNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 9928 - protein, 568 aa, Artificial Sequence
  hemagglutinin__InfluenzaA__AGI02565
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKAIPANDLCYPGDFNDYEELKHLLSRINHFEKIQIIPKSSWSNHEASLGVSSACPYLGKPSFFRNVVWLIKKNSTYPTIKRSYNNTNQEDLLVLWGIHHPNDAAEQTKLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 9929 - protein, 567 aa, Artificial Sequence
  hemagglutinin__InfluenzaA__AGI02566
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQENLLILWGIHHSNDAAEQIKLYQNPTTYISVGTSTLNQRLVPKIATRSKVNGQSGRMDFFWTILKPNDAINFESNGNFIAPEYAYKIVKEGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 9930 - protein, 568 aa, Artificial Sequence
  hemagglutinin__InfluenzaA__AGI02567
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKANPANDLCYPGNFNDYEELKHLLSRINHFEKIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 9931 - protein, 567 aa, Artificial Sequence
  hemagglutinin__InfluenzaA__AGI02568
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQENLLILWGIHHSNDATEQIKLYQNPTTYISVGTSTLNQRLVPKIGTRSKVNGQSGRMDFFWTILKPNDAINFESNGNFIAPEYAYKIVKEGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESMGIYQILSIYSTVASSLALAIMVAGLSLWMCSNGSLQCRICI

SEQ ID NO: 9932 - protein, 560 aa, Artificial Sequence
  hemagglutinin__InfluenzaA__AGI60301
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGISGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 9933 - protein, 560 aa, Artificial Sequence
  hemagglutinin__InfluenzaA__AGJ72861
MNTQILVFALIAIIPTNADKICLGHHAVSNGTKVNTLTERGGEVVNATETVERTNIPRICSKGKKTVDLGQGGPRGTITGPPQCDQFLEFSADLIMERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 9934 - protein, 566 aa, Artificial Sequence
  hemagglutinin__InfluenzaA__AGJ73327
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADHQSLYQNADAYVFVGTSRYSKKFKPEIAIRPKVRDQEGRMNYYWTLIEPGDKITFEATGNLVVPRYAFAMERNAGSGIIIPDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKLDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGEISFWMCSNGSLQCRICI

SEQ ID NO: 9935 - protein, 566 aa, Artificial Sequence
  hemagglutinin__InfluenzaA__AGJ73329
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDAPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9936 - protein, 566 aa, Artificial Sequence
  hemagglutinin__InfluenzaA__AGJ73331
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSKVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9937 - protein, 566 aa, Artificial Sequence
  hemagglutinin__InfluenzaA__AGJ73333
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9938 - protein, 566 aa, Artificial Sequence
  hemagglutinin__InfluenzaA__AGJ73335
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPRDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9939 - protein, 566 aa, Artificial Sequence; identical to SEQ ID NO: 6454
  hemagglutinin__InfluenzaA__AGJ73337

SEQ ID NO: 9940 - protein, 566 aa, Artificial Sequence; identical to SEQ ID NO: 6454
  hemagglutinin__InfluenzaA__AGJ73339

SEQ ID NO: 9941 - protein, 566 aa, Artificial Sequence; identical to SEQ ID NO: 6454
  hemagglutinin__InfluenzaA__AGJ73341

SEQ ID NO: 9942 - protein, 566 aa, Artificial Sequence
  hemagglutinin__InfluenzaA__AGJ73343
MKAILVVLLYTFATANADTLCIGYHANNSTDTVDTVLEKNVTVTHSVNLLEDKQNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9943 - protein, 566 aa, Artificial Sequence
  hemagglutinin__InfluenzaA__AGJ73345
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNEDAYVFVGTSKYSKKFKPEIAVRPKVRDQEGRMNYYWTLVEPGNKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9944 - protein, 566 aa, Artificial Sequence; identical to SEQ ID NO: 7050
  hemagglutinin__InfluenzaA__AGJ73347

SEQ ID NO: 9945 - protein, 566 aa, Artificial Sequence; identical to SEQ ID NO: 7050
  hemagglutinin__InfluenzaA__AGJ73349

SEQ ID NO: 9946 - protein, 566 aa, Artificial Sequence
  hemagglutinin__InfluenzaA__AGJ73351
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKMRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9947 - protein, 566 aa, Artificial Sequence
  hemagglutinin__InfluenzaA__AGJ73353
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQSIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9948 - protein, 566 aa, Artificial Sequence
  hemagglutinin__InfluenzaA__AGJ73355
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGATSFWMCSNGSLQCRICI

SEQ ID NO: 9949 - protein, 566 aa, Artificial Sequence; identical to SEQ ID NO: 6867
  hemagglutinin__InfluenzaA__AGJ73357

SEQ ID NO: 9950 - protein, 566 aa, Artificial Sequence
  hemagglutinin__InfluenzaA__AGJ73361
MKAILVVLLYTFATANADTLCIGYHANNSTDTVDTVLEKNVTVTHSVNLLEDKHNGKLCKLRGVAPLHLGKCNIAGWILGNPECESLSTSSSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIFISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9951 - protein, 566 aa, Artificial Sequence; identical to SEQ ID NO: 7050
  hemagglutinin__InfluenzaA__AGJ73363

SEQ ID NO: 9952 - protein, 566 aa, Artificial Sequence; identical to SEQ ID NO: 6867
  hemagglutinin__InfluenzaA__AGJ73365

SEQ ID NO: 9953 - protein, 566 aa, Artificial Sequence
  hemagglutinin__InfluenzaA__AGJ73367
MKAILVVLLYTFATANADTLCIGYHANNSTDTVDTVLEKNVTVTHSVNLLEDKHNGKLCKLRGVAPLHLGKCNIAGWILGNPECESLSTASSWPYIVETSSSDNGTCYPGDFINYEELREQLSSVSSFERFEIFPKTSSWPNHDSNKGVAAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVQDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9954 - protein, 566 aa, Artificial Sequence
  hemagglutinin__InfluenzaA__AGJ73369
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSAEAKLNREEIDGVKLESTRIYQILAIYSTVASSLVLVVSLGAISFWMCSNGSLQCRICI

SEQ ID NO: 9955 - protein, 566 aa, Artificial Sequence; identical to SEQ ID NO: 6454
  hemagglutinin__InfluenzaA__AGJ73371

SEQ ID NO: 9956 - protein, 566 aa, Artificial Sequence
  hemagglutinin__InfluenzaA__AGJ73373
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSHPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9957 - protein, 566 aa, Artificial Sequence
  hemagglutinin__InfluenzaA__AGJ73375
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPETSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9958 - protein, 566 aa, Artificial Sequence
  hemagglutinin__InfluenzaA__AGJ73377
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTASCPRAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFNHKCDNTCMESVKNGTYDYPKYSEEAKLNKEEIDGVKLESTRIYQILAIYSTVASSLVLVVSLGAISFWMCSNGSLQCRICI

SEQ ID NO: 9959 - protein, 566 aa, Artificial Sequence
  hemagglutinin__InfluenzaA__AGJ73380
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRGQEGRMNYYWTLIEPGDKITFEATGNLVVPRYAFAMERNAGSGIIISDTPVHDCNSTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELFVLLENERTLDYHDSNVKDLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 9960 - protein, 566 aa, Artificial Sequence
  hemagglutinin__InfluenzaA__AGK62991
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQASGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9961 - protein, 566 aa, Artificial Sequence
  hemagglutinin__InfluenzaA__AGK62993
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPISKCNSACITTNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWSCQKGNIRCNICI

SEQ ID NO: 9962 - protein, 566 aa, Artificial Sequence
  hemagglutinin__InfluenzaA__AGK62995
MKTIIALSYILCLVFAQKLPGNDNSTATLCLGHHAGPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9963 - protein, 566 aa, Artificial Sequence
  hemagglutinin__InfluenzaA__AGK62997
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNDKFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITCGACARYVKQNTLKLATGMRNVPEKQTRGIFGAIAVFIENGWEGMVDGWYGFRHQNSEGREQAAAFQSTQAAIDQIIGKLNRLIGETNEKFHQIEKEFSEVERRIQALEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWSCQKGNIRCNICI

SEQ ID NO: 9964 - protein, 566 aa, Artificial Sequence
  hemagglutinin__InfluenzaA__AGK62999
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9965 - protein, 566 aa, Artificial Sequence
  hemagglutinin__InfluenzaA__AGK63001
MKTIIALSYILCLVFAQKLPGNDNSTATLCLVHHAVPNGTIVKTITNDQIEVTNATELVQSSSTGEICDSPHQILDGENCTLIDALLGDPQCDGFQNKEWDLFVERSKAYSNCYPYDVPDYASLRSLVASSGTLEFNNESFNWTGVTQNGTSSACIRRSNSSFFSRLNGLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGREQAADFQSTQAAIDQIIGKLNRLIGKTNEKFHQIEKEFSEVERRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWSCQKGNIRCNICI

SEQ ID NO: 9966 - protein, 566 aa, Artificial Sequence
  hemagglutinin__InfluenzaA__AGK63003
MKTIIALSYILCLVFAQKLPGNDNSTATLCLGHHAGPNGTIVKTITNDQIEVTNATELVQSSSTGEICDSPHQILDGENCTLIDALLGDPQCDGFQNKKWDLFIERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSACITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9967 - protein, 566 aa, Artificial Sequence
  hemagglutinin__InfluenzaA__AGK63005
MKTIIALSYILCLVFAQKLPGNDNSTATLCLVHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNGLTHLNFKYPALDVTMPNNDKFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAVFIENGWEGMVDGWYGFRHQNSEGREQAADFQSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9968 - protein, 566 aa, Artificial Sequence
  hemagglutinin__InfluenzaA__AGK63007
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9969 - protein, 566 aa, Artificial Sequence
  hemagglutinin__InfluenzaA__AGK63009
MKTIIALSYILCLVFAQKLPGNDNSTATLCLGHHAVPNGTIVKTITNDQIEVTNATELVQSSSTGEICNSPHQILDGENCTLIDALLGDPQCDGLQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9970 - protein, 566 aa, Artificial Sequence
  hemagglutinin__InfluenzaA__AGK63011
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9971 - protein, 566 aa, Artificial Sequence
  hemagglutinin__InfluenzaA__AGK63013
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALDVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACARYVKQNTLKLATGMRNVPEKQTRGIFGAIAVFIENGWEGMVDGWYGFRHQNSEGRGQAAALQSTQAAIDQITGKLNRLIGETNEKFHQIEKEFSEVEGRIQALEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWSCQKGNIRCNICI

SEQ ID NO: 9972 - protein, 566 aa, Artificial Sequence
  hemagglutinin__InfluenzaA__AGK63015
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRKSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9973 - protein, 566 aa, Artificial Sequence; identical to SEQ ID NO: 6982
  hemagglutinin__InfluenzaA__AGK63017

SEQ ID NO: 9974 - protein, 566 aa, Artificial Sequence
  hemagglutinin__InfluenzaA__AGK63019
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9975 - protein, 566 aa, Artificial Sequence; identical to SEQ ID NO: 9849
  hemagglutinin__InfluenzaA__AGK63021

SEQ ID NO: 9976 - protein, 566 aa, Artificial Sequence
  hemagglutinin__InfluenzaA__AGK63025
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFIERSKAYSNCYPYDVPDYASLRSLVASSGTLEFNNESFNWTGVTQNGTSSACIRKSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 9977 - protein, 566 aa, Artificial Sequence; identical to SEQ ID NO: 9074
  hemagglutinin__InfluenzaA__AGK63027

SEQ ID NO: 9978 - protein, 566 aa, Artificial Sequence
  hemagglutinin__InfluenzaA__AGK63029
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITTNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9979 - protein, 566 aa, Artificial Sequence
  hemagglutinin__InfluenzaA__AGK63031
MKTIIALSYILCLVFAQKLPGNDNSTATLCLGHHAVPNGTIVKTITNDQIEVTNATELVQSSSTGEICDSPHQILDGENCTLIDALLGDPQCDGFQKKKWDLFVERSKAHSNCYPYDVPDYASLRSLVASSGTLEFNNESFNWTGVTQNGTSSACIRRSNNSFFSRLNWLTHLNFKYPALNVIMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKLHQIEKEFSEVEGRILDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9980 - protein, 566 aa, Artificial Sequence
  hemagglutinin__InfluenzaA__AGK63033
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLIVERSKAYSNCYPYDVPDYASLRSLVASSGTLEFNNESFNWTGVTQNGTSSACIRKSNSSFFSRLNWLTHLNFKYPALNVTMPNNEQFDKLYIWGVHHPGTDKDQIFLYAQASGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9981 - protein, 566 aa, Artificial Sequence
  hemagglutinin__InfluenzaA__AGK63035
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9982 - protein, 566 aa, Artificial Sequence
  hemagglutinin__InfluenzaA__AGK63037
MKTIIALSYILCLVFAQELPGNDNSTATLCLGHHAVPNGTIVKTITNDQIEVTNATELVQSSSTGEICNSPHQILDGENCTLIDALLGDPQCDGFQNKKWDLFVERSKAHSNCNPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAQLLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9983 - protein, 566 aa, Artificial Sequence
  hemagglutinin__InfluenzaA__AGK63039
MKTIIALSYILCLVFAQKLPGNDNSTATLCLGHHAVPNGTIVKTITNDQIEVTNATELVQSSSTGEICNSPHQILDGENCTLIDALLGDPQCDGFQKKKWDLFVERSKAHSNCYPYDVPDYASLRSLVASSGTLEFNNESFNWTGVTQNGTSSACIRRSNNSFFSRLNWLTHLNFKYPALNVTLPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPISKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWSCQKGNIRCNICI

SEQ ID NO: 9984 - protein, 566 aa, Artificial Sequence
  hemagglutinin__InfluenzaA__AGK63041
MKTIIALSYILCLVFAQKLPGNDNSTATLCLGHHAVPNGTIVKTITNDQIEVTNATELVQSSSTGEICDSPHQILDGENCTLIDALLGDPQCDGLQNKKWDLIVERSKAHSYCYPYDVPDYASLRSLVASSGTLEFNNESFNWTEVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9985 - protein, 566 aa, Artificial Sequence
  hemagglutinin__InfluenzaA__AGK63043
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9986 - protein, 566 aa, Artificial Sequence
  hemagglutinin__InfluenzaA__AGK63045
MKTIIALSYILCLVFAQKLPGNDNSTATLCLGHHAVPNGTIVKTITNDQIEVTNATELVQSSSTGEICNSPHQILDGENCTLIDALLGDPQCDGFQKKKWDLFVERSKAYSNCYPYDVPDYASLRSLVASSGTLEFNNESFNWTGVTQNGTSSACIRKSNSSFFSRLNWLTHLNFKYPALNVTMPNNEQFDKLYIWGVHHPGTDKDQIFLYAQASGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAQLLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9987 - protein, 566 aa, Artificial Sequence
  hemagglutinin__InfluenzaA__AGK63047
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDREGRMNYYWTLIEPGDKITFEATGNLVVPRYAFAMERNAGSGIIISDTPVHDCNTACQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 9988 - protein, 560 aa, Artificial Sequence
  hemagglutinin__InfluenzaA__AGK82158
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 9989 - protein, 560 aa, Artificial Sequence
  hemagglutinin__InfluenzaA__AGK84857
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQITKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 9990 - protein, 560 aa, Artificial Sequence
  hemagglutinin__InfluenzaA__AGK84860
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 9991 - protein, 560 aa, Artificial Sequence
  hemagglutinin__InfluenzaA__AGK84863
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 9992 - protein, 566 aa, Artificial Sequence
  hemagglutinin__InfluenzaA__AGL07713
MKAILVVLLYTFATANADTLCIGYHANNSTDTVDTVLEKNVTVTRSVNLLEDKHNGKLCKLRGVAPLHLGKCNIAGWILGNPECESLSTASSWSYIVETSSSDNGTCYPGDFIDYEELREQLSSVSSFERFEIFPKTGSWPNHDSNKGVTAACPHAGAKGFYKNLIWLVEKGNSYPKLSKSYINDKGKEVLVLWGIHHPSTTADQQRLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 9993 - protein, 566 aa, Artificial Sequence
  hemagglutinin__InfluenzaA__AGL09731
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9994 - protein, 566 aa, Artificial Sequence
  hemagglutinin__InfluenzaA__AGL09732
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9995 - protein, 566 aa, Artificial Sequence
  hemagglutinin__InfluenzaA__AGL09734
MKTIIALSYILCLVFAQKFPGNDNSTATLCLGHHAVPNGTIVKTITNDRIEVTNATELVQNSSIGEICDSPHQILDGENCTLIDALLGDPQCDGFQNKKWDLFIERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9996 - protein, 566 aa, Artificial Sequence
  hemagglutinin__InfluenzaA__AGL09735
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNISI

SEQ ID NO: 9997 - protein, 566 aa, Artificial Sequence
  hemagglutinin__InfluenzaA__AGL09736
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 9998 - protein, 566 aa, Artificial Sequence; identical to SEQ ID NO: 9883
  hemagglutinin__InfluenzaA__AGL09737

SEQ ID NO: 9999 - protein, 566 aa, Artificial Sequence
  hemagglutinin__InfluenzaA__AGL09739
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSSCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10000 - protein, 566 aa, Artificial Sequence; identical to SEQ ID NO: 9835
  hemagglutinin__InfluenzaA__AGL09740

SEQ ID NO: 10001 - protein, 566 aa, Artificial Sequence; identical to SEQ ID NO: 9074
  hemagglutinin__InfluenzaA__AGL09741

SEQ ID NO: 10002 - protein, 566 aa, Artificial Sequence
  hemagglutinin__InfluenzaA__AGL09742
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPETQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELRSGYKDWILWISFAISCFLLCVALLGFIMWACQKGNIRCSICI

SEQ ID NO: 10003 - protein, 566 aa, Artificial Sequence; identical to SEQ ID NO: 9858
  hemagglutinin__InfluenzaA__AGL09744

SEQ ID NO: 10004 - protein, 566 aa, Artificial Sequence
  hemagglutinin__InfluenzaA__AGL09745
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDVGNGCFKIYHKCDNTCIGSIRNGTYDHNVYRDEALNNRFQIKGVELKSGYKDWILWISFAISCFLLCVALLGFIMWACQKGNIRCNICI

SEQ ID NO: 10005 - protein, 566 aa, Artificial Sequence; identical to SEQ ID NO: 9997
  hemagglutinin__InfluenzaA__AGL09746

SEQ ID NO: 10006 - protein, 566 aa, Artificial Sequence; identical to SEQ ID NO: 9835
  hemagglutinin__InfluenzaA__AGL09747

SEQ ID NO: 10007 - protein, 566 aa, Artificial Sequence; identical to SEQ ID NO: 9858
  hemagglutinin__InfluenzaA__AGL09748

SEQ ID NO: 10008 - protein, 566 aa, Artificial Sequence; identical to SEQ ID NO: 9856
  hemagglutinin__InfluenzaA__AGL09749

SEQ ID NO: 10009 - protein, 566 aa, Artificial Sequence; identical to SEQ ID NO: 9994
  hemagglutinin__InfluenzaA__AGL09750

SEQ ID NO: 10010 - protein, 566 aa, Artificial Sequence; identical to SEQ ID NO: 9835
  hemagglutinin__InfluenzaA__AGL09751

SEQ ID NO: 10011 - protein, 566 aa, Artificial Sequence; identical to SEQ ID NO: 9994
  hemagglutinin__InfluenzaA__AGL09753

SEQ ID NO: 10012 - protein, 566 aa, Artificial Sequence
  hemagglutinin__InfluenzaA__AGL09754
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCLLLCVALLGFIMWACQKGNIRCNICI

SEQ ID NO: 10013 - protein, 566 aa, Artificial Sequence; identical to SEQ ID NO: 9997
  hemagglutinin__InfluenzaA__AGL09756

SEQ ID NO: 10014 - protein, 566 aa, Artificial Sequence
  hemagglutinin__InfluenzaA__AGL09758
MKAILVVLLYTFATANADTLCIGYHANNSTDTVDTVLEKNVTVTHSVNLLEDKHNGKICKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSNSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTTVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNMCMESVKNGTYDYPKYSEEAKLNREKIDGVKLESTRIYQILAIYSTVASSLVLVVSLGAISFWMCSNGSLQCRICI

SEQ ID NO: 10015 - protein, 566 aa, Artificial Sequence
  hemagglutinin__InfluenzaA__AGL09760
MKTIIAVSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10016 - protein, 566 aa, Artificial Sequence; identical to SEQ ID NO: 9868
  hemagglutinin__InfluenzaA__AGL09761

SEQ ID NO: 10017 - protein, 566 aa, Artificial Sequence
  hemagglutinin__InfluenzaA__AGL09762
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10018 - protein, 566 aa, Artificial Sequence; identical to SEQ ID NO: 9994
  hemagglutinin__InfluenzaA__AGL09763

SEQ ID NO: 10019 - protein, 566 aa, Artificial Sequence
  hemagglutinin__InfluenzaA__AGL09764
MKTIIALSYILCLVFAQKIPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10020 - protein, 566 aa, Artificial Sequence; identical to SEQ ID NO: 9858
  hemagglutinin__InfluenzaA__AGL09765

SEQ ID NO: 10021 - protein, 566 aa, Artificial Sequence
  hemagglutinin__InfluenzaA__AGL09766
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKILSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10022 - protein, 566 aa, Artificial Sequence
  hemagglutinin__InfluenzaA__AGL09767
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10023 - protein, 566 aa, Artificial Sequence
  hemagglutinin__InfluenzaA__AGL09769
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10024 - protein, 566 aa, Artificial Sequence; identical to SEQ ID NO: 9858
  hemagglutinin__InfluenzaA__AGL09770

SEQ ID NO: 10025 - protein, 566 aa, Artificial Sequence
  hemagglutinin__InfluenzaA__AGL09771
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDIYRDEALNNRFQIKGVELKSGYKDWILWISFAISCFLLCVALLGFIMWACQKGNIRCNICI

SEQ ID NO: 10026 - protein, 566 aa, Artificial Sequence
  hemagglutinin__InfluenzaA__AGL09772
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHYVYRDEALNNRFQIKGVELKSGYKDWILWISFATSCFLLCVALLGFIMWACQKGNIRCNICI

SEQ ID NO: 10027 - protein, 566 aa, Artificial Sequence
  hemagglutinin__InfluenzaA__AGL09773
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTEVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHYVYRDEALNNRFQIKGVELKSGYKDWILWISFATSCFLLCVALLGFIMWACQKGNIRCNICI

SEQ ID NO: 10028 - protein, 566 aa, Artificial Sequence; identical to SEQ ID NO: 10026
  hemagglutinin__InfluenzaA__AGL09774

SEQ ID NO: 10029 - protein, 566 aa, Artificial Sequence; identical to SEQ ID NO: 9868
  hemagglutinin__InfluenzaA__AGL09775

SEQ ID NO: 10030 - protein, 566 aa, Artificial Sequence; identical to SEQ ID NO: 10026
  hemagglutinin__InfluenzaA__AGL09776

SEQ ID NO: 10031 - protein, 566 aa, Artificial Sequence; identical to SEQ ID NO: 10026
  hemagglutinin__InfluenzaA__AGL09777

SEQ ID NO: 10032 - protein, 566 aa, Artificial Sequence
  hemagglutinin__InfluenzaA__AGL09778
MKTIIALSYILCLIFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10033 - protein, 566 aa, Artificial Sequence
  hemagglutinin__InfluenzaA__AGL09779
MKTIIALSYILCLVFAQKLPGNNNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10034 - protein, 566 aa, Artificial Sequence
  hemagglutinin__InfluenzaA__AGL09780
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFDNESFNWAGVTQNGTSSACIRGSNSSFFSRLNWLTHLNFKYPALNVTMPNNEQFDKLYIWGVHHPGTDKDQISLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10035 - protein, 566 aa, Artificial Sequence; identical to SEQ ID NO: 9993
  hemagglutinin__InfluenzaA__AGL09781

SEQ ID NO: 10036 - protein, 566 aa, Artificial Sequence; identical to SEQ ID NO: 9858
  hemagglutinin__InfluenzaA__AGL09782

SEQ ID NO: 10037 - protein, 566 aa, Artificial Sequence
  hemagglutinin__InfluenzaA__AGL09783
MKTIIALSYILCLVFAQKLPGNDNSTATLCLGHHAVPNGTVVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRTQNLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 10038 - protein, 566 aa, Artificial Sequence; identical to SEQ ID NO: 9868
  hemagglutinin__InfluenzaA__AGL09785

SEQ ID NO: 10039 - protein, 566 aa, Artificial Sequence
  hemagglutinin__InfluenzaA__AGL09786
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFDNESFNWAGVTQNGTSSACIRGSKSSFFSRLNWLTHLNFKYPALNVTMPNNEQFDKLYIWGVHHPGTDKDQISLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10040 - protein, 566 aa, Artificial Sequence
  hemagglutinin__InfluenzaA__AGL09787
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10041 - protein, 566 aa, Artificial Sequence; identical to SEQ ID NO: 10040
  hemagglutinin__InfluenzaA__AGL09788

SEQ ID NO: 10042 - protein, 566 aa, Artificial Sequence; identical to SEQ ID NO: 10040
  hemagglutinin__InfluenzaA__AGL09789

SEQ ID NO: 10043 - protein, 566 aa, Artificial Sequence; identical to SEQ ID NO: 9994
  hemagglutinin__InfluenzaA__AGL09790

SEQ ID NO: 10044 - protein, 566 aa, Artificial Sequence
  hemagglutinin__InfluenzaA__AGL09791
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNMTMPNNEQFDKLYIWGVHHPGTDKDQISLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10045 - protein, 566 aa, Artificial Sequence; identical to SEQ ID NO: 9994
  hemagglutinin__InfluenzaA__AGL09792

SEQ ID NO: 10046 - protein, 566 aa, Artificial Sequence
  hemagglutinin__InfluenzaA__AGL09794
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDTPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10047 - protein, 566 aa, Artificial Sequence; identical to SEQ ID NO: 9994
  hemagglutinin__InfluenzaA__AGL09795

SEQ ID NO: 10048 - protein, 566 aa, Artificial Sequence
  hemagglutinin__InfluenzaA__AGL09797
MKTIIALSYILCLVFSQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10049 - protein, 566 aa, Artificial Sequence
  hemagglutinin__InfluenzaA__AGL09798
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNFEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHYVYRDEALNNRFQIKGVELKSGYKDWILWISFAISCFLLCVALLGFIMWACQKGNIRCNICI

SEQ ID NO: 10050 - protein, 566 aa, Artificial Sequence; identical to SEQ ID NO: 10048
  hemagglutinin__InfluenzaA__AGL09799

SEQ ID NO: 10051 - protein, 566 aa, Artificial Sequence; identical to SEQ ID NO: 9994
  hemagglutinin__InfluenzaA__AGL09800

SEQ ID NO: 10052 - protein, 566 aa, Artificial Sequence; identical to SEQ ID NO: 9858
  hemagglutinin__InfluenzaA__AGL09801

SEQ ID NO: 10053 - protein, 566 aa, Artificial Sequence; identical to SEQ ID NO: 9858
  hemagglutinin__InfluenzaA__AGL09802

SEQ ID NO: 10054 - protein, 566 aa, Artificial Sequence
  hemagglutinin__InfluenzaA__AGL09803
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQRTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10055 - protein, 566 aa, Artificial Sequence; identical to SEQ ID NO: 9891
  hemagglutinin__InfluenzaA__AGL09804

SEQ ID NO: 10056 - protein, 566 aa, Artificial Sequence; identical to SEQ ID NO: 9997
  hemagglutinin__InfluenzaA__AGL09805

SEQ ID NO: 10057 - protein, 566 aa, Artificial Sequence; identical to SEQ ID NO: 10026
  hemagglutinin__InfluenzaA__AGL09806

SEQ ID NO: 10058 - protein, 566 aa, Artificial Sequence; identical to SEQ ID NO: 9997
  hemagglutinin__InfluenzaA__AGL09807

SEQ ID NO: 10059 - protein, 566 aa, Artificial Sequence
  hemagglutinin__InfluenzaA__AGL09808
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNVGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10060 - protein, 566 aa, Artificial Sequence
  hemagglutinin__InfluenzaA__AGL09809
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPHAGAKGFYKNLIWLVKKGNSYPKLSISYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10061 - protein, 566 aa, Artificial Sequence
  hemagglutinin__InfluenzaA__AGL09810
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFSNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGTCPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACMGSIRNGTYDHDVYRDEALNNRFQIKGVELKSGYKDWILWISFAISCFLLCVALLGFIMWACQKGNIRCNICI

SEQ ID NO: 10062 - protein, 566 aa, Artificial Sequence; identical to SEQ ID NO: 9858
  hemagglutinin__InfluenzaA__AGL09811

SEQ ID NO: 10063 - protein, 566 aa, Artificial Sequence
  hemagglutinin__InfluenzaA__AGL09812
MKTIIALSYILCLVFAQKLPGNDNSTATLCLGHHAVPNGTIVKTITNDRIEVTNATELVQNSSIGEICDSPHQILDGENCTLIDALLGDPQCDGFQDKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10064 - protein, 566 aa, Artificial Sequence; identical to SEQ ID NO: 9835
  hemagglutinin__InfluenzaA__AGL09813

SEQ ID NO: 10065 - protein, 566 aa, Artificial Sequence; identical to SEQ ID NO: 9883
  hemagglutinin__InfluenzaA__AGL09814

SEQ ID NO: 10066 - protein, 566 aa, Artificial Sequence
  hemagglutinin__InfluenzaA__AGL09815
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRSIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10067 - protein, 566 aa, Artificial Sequence; identical to SEQ ID NO: 9883
  hemagglutinin__InfluenzaA__AGL09816

SEQ ID NO: 10068 - protein, 566 aa, Artificial Sequence
  hemagglutinin__InfluenzaA__AGL09817
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNSESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10069 - protein, 566 aa, Artificial Sequence; identical to SEQ ID NO: 9883
  hemagglutinin__InfluenzaA__AGL09818

SEQ ID NO: 10070 - protein, 566 aa, Artificial Sequence; identical to SEQ ID NO: 9994
  hemagglutinin__InfluenzaA__AGL09819

SEQ ID NO: 10071 - protein, 566 aa, Artificial Sequence
  hemagglutinin__InfluenzaA__AGL09820
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEIEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10072 - protein, 566 aa, Artificial Sequence
  hemagglutinin__InfluenzaA__AGL09821
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGIELKSGYKDWILWISFAISCFLLCVALLGFIMWACQKGNIRCNICI

SEQ ID NO: 10073 - protein, 566 aa, Artificial Sequence; identical to SEQ ID NO: 9997
  hemagglutinin__InfluenzaA__AGL09822

SEQ ID NO: 10074 - protein, 566 aa, Artificial Sequence; identical to SEQ ID NO: 10040
  hemagglutinin__InfluenzaA__AGL09823

SEQ ID NO: 10075 - protein, 566 aa, Artificial Sequence
  hemagglutinin__InfluenzaA__AGL09824
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGTKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10076 - protein, 566 aa, Artificial Sequence; identical to SEQ ID NO: 9994
  hemagglutinin__InfluenzaA__AGL09825

SEQ ID NO: 10077 - protein, 566 aa, Artificial Sequence; identical to SEQ ID NO: 10075
  hemagglutinin__InfluenzaA__AGL09826

SEQ ID NO: 10078 - protein, 566 aa, Artificial Sequence; identical to SEQ ID NO: 9868
  hemagglutinin__InfluenzaA__AGL09827

SEQ ID NO: 10079 - protein, 566 aa, Artificial Sequence
  hemagglutinin__InfluenzaA__AGL09828
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGYRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10080 - protein, 566 aa, Artificial Sequence
  hemagglutinin__InfluenzaA__AGL09829
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLESTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10081 - protein, 566 aa, Artificial Sequence; identical to SEQ ID NO: 9883
  hemagglutinin__InfluenzaA__AGL09830

SEQ ID NO: 10082 - protein, 566 aa, Artificial Sequence; identical to SEQ ID NO: 9993
  hemagglutinin__InfluenzaA__AGL09831

SEQ ID NO: 10083 - protein, 566 aa, Artificial Sequence
  hemagglutinin__InfluenzaA__AGL09832
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGTIRNGTYDHNVYRDEALNNRFQIKGVELKSGYKDWILWISFAISCFLLCVALLGFIMWACQKGNIRCNICI

SEQ ID NO: 10084 - protein, 566 aa, Artificial Sequence; identical to SEQ ID NO: 9994
  hemagglutinin__InfluenzaA__AGL09833

SEQ ID NO: 10085 - protein, 566 aa, Artificial Sequence
  hemagglutinin__InfluenzaA__AGL09881
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGASSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10086 - protein, 566 aa, Artificial Sequence; identical to SEQ ID NO: 9858
  hemagglutinin__InfluenzaA__AGL09882

SEQ ID NO: 10087 - protein, 566 aa, Artificial Sequence; identical to SEQ ID NO: 9835
  hemagglutinin__InfluenzaA__AGL09883

SEQ ID NO: 10088 - protein, 566 aa, Artificial Sequence; identical to SEQ ID NO: 9835
  hemagglutinin__InfluenzaA__AGL09884

SEQ ID NO: 10089 - protein, 560 aa, Artificial Sequence; identical to SEQ ID NO: 9988
  hemagglutinin__InfluenzaA__AGL44438

SEQ ID NO: 10090 - protein, 566 aa, Artificial Sequence
  hemagglutinin__InfluenzaA__AGN69267
MKAILVVLLYTFTTGNADTLCIGYHANNSTDTVDTVLEKNVTVTHSVNLLEDRHNGKLCKLRGVAPLHLGKCNIAGWLLGNPECELLFTASSWSYIVETSNSDNGTCYPGDFINYEELREQLSSVSSFERFEIFPKASSWPNHETNRGVTAACPYAGANSFYRNLIWLVKKGNSYPKLSKSYINNKEKEVLVLWGIHHPPTSTDQQSLYQNADAYVFVGSSKYSKKFKPEIATRPKVRGQAGRMNYYWTLVEPGDTITFEATGNLVVPRYAFAMKRGSGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNKKVDDGLLDVWTYNAELLVLLENERTLDYHDSNVKNLYEKVRSQLKNNAKEIGNGCFEFYHKCDDTCMESVKNGTYDYPKYSEEAKLNREEIDGVKLESTRIYQILAIYSTVASSLVLLVSLGAISFWMCSNGSLQCRICI

SEQ ID NO: 10091 - protein, 566 aa, Artificial Sequence
  hemagglutinin__InfluenzaA__AGN69278
MKAILVVLLYTFTTANADTLCIGYHANNSTDTVDTVLEKNVTVTHSVNLLEDRHNGKLCKLRGVAPLHLGKCNIAGWLLGNPECELLFTASSWSYIVETSNSDNGTCYPGDFINYEELREQLSSVSSFERFEIFPKASSWPNHEPNRGVTAACPYAGANSFYRNLIWLVKKGNSYPKLSKSYINNKEKEVLVLWGIHHPPTSTDQQSLYQNADAYVFVGSSKYNKKFKPEIATRPKVRGQAGRMNYYWTLVEPGDTITFEATGNLVVPRYAFAMKRGSGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNKKVDDGLLDVWTYNAELLVLLENERTLDYHDSNVKNLYEKVRSQLKNNAKEIGNGCFEFYHKCDDTCMESVKNGTYDYPKYSEEAKLNREEIDGVKLESTRIYQILAIYSTVASSLVLLVSLGAISFWMCSNGSLQCRICI

SEQ ID NO: 10092 - protein, 566 aa, Artificial Sequence
  hemagglutinin__InfluenzaA__AGN69302
MEAKLFVLFCAFTALKADTICVGYHANNSTDTVDTILEKNVTVTHSVNLLENSHNGKLCSLNGKIPLQLGNCNVAGWILGNPKCDLLLTANSWSYIIETSNSKDGACYPGEFADYEELKEQLSTVSSFERFEIFPKATSWPNHDTTRGTTVACSHSGANSFYRNLLWIVKKGNSYPKLSKSYTNNKGKEVLVIWGVHHPPTDSDQQTLYQNNHTYVSVGSSKYYKRFTPEIVARPKVREQAGRMNYYWTLLDQGDTITFEATGNLIAPWHAFALKKGSSSGIMMSDAQVHNCTTKCQTPHGALKGNLPFQNVHPVTIGECPKYVKSTQLRMATGLRNIPSIQSRGLFGAIAGFIEGGWTGMVDGWYGYHHQNEQGSGYAADQKSTQIAIDGISNKVNSVIEKMNIQFTSVGKEFNSLEKRMENLNKKVDDGFLDVWTYNAELLILLENERTLDFHDLNVKNLYEKVKSQLRNNAKEIGNGCFEFYHKCDNECMESVKNGTYNYPKYSEESKLNREEIDGVKLESMGIHQILAIYSTVASSLVLLVSLGAISFWMCSNGSLQCRVCI

SEQ ID NO: 10093 - protein, 566 aa, Artificial Sequence; identical to SEQ ID NO: 10092
  hemagglutinin__InfluenzaA__AGN69314

SEQ ID NO: 10094 - protein, 566 aa, Artificial Sequence; identical to SEQ ID NO: 10092
  hemagglutinin__InfluenzaA__AGN69326

SEQ ID NO: 10095 - protein, 566 aa, Artificial Sequence
  hemagglutinin__InfluenzaA__AGN69338
MEAKLFVLFCAFTALKADTICVGYHANNSTDTVDTILEKNVTVTHSVNLLENSHNGKLCSLNGKIPLQLGNCNVAGWILGNPKCDLLLTANSWSYIIETSNSKNGACYPGEFADYEELKEQLSTVSSFERFEIFPKATSWPNHDTTRGTTVACSHSGANSFYRNLLWIVKKGNSYPKLSKSYTNNKGKEVLVIWGVHHPPTDSDQQTLYQNNHTYVSVGSSKYYKRFTPEIVARPKVREQAGRMNYYWTLLHQGDTITFEATGNLIAPWHAFALNEGSSSGIMRSDAQVHNCTTKCQTPHGALKGNLPFQNVHPVTIGECPKYVKSTQLRMATGLRNIPSIQSRGLFGAIAGFIEGGWTGMVDGWYGYHHRNEQGSGYAADQKSTQIAIDGISNKVNSVIEKMNIQFTSVGKECNSLEKRMENLNKKVDDGFLDVWTYNAELLILLENERTLDFHDLNVKNLYEKVKSQLRNNAKEIGNGCFEFYHKCDNECMESVKNGTYNYPKYSEESKLNREEIDGVKLESMGIHQILAIYSTVASSLVLLVSLGAISFWMCSNGSLQCRVCI

SEQ ID NO: 10096 - protein, 566 aa, Artificial Sequence
  hemagglutinin__InfluenzaA__AGO00265
MKARLLVLLCAIAATDADTICIGYHANNSTDTVDTILEKNVTVTHSVNLLEDSHNGKLCRLKGIAPLQLGKCNIAGWILGNPECESLLSERSWSYIVETPNSENGTCYPGDFIDYEELREQLSSVTSFERFEIFPKETSWPKHNTTKGVTAACSHAGKCSFYRNLLWLTEKDGSYPNLNNSYVNKKGKEVLVLWGVHHPSNIKDQQTLYQKENAYVSVVSSNYNRRFTPEIAERPKVRGQAGRMNYYWTLLEPGDTIIFEANGNLIAPWYAFALSRGFGSGIITSNASMHECNTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKSQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 10097 - protein, 566 aa, Artificial Sequence
  hemagglutinin__InfluenzaA__AGO00277
MKAKLLILLCALSATDADTICIGYHANNSTDTVDTVLEKNVTVTHSVNLLEDSHNGKLCRLKGIAPLQLGKCNIAGWILGNPECESLLSKRSWSYIAETPNSENGTCYPGDFADYEELREQLSSVSSFERFEIFPKERSWPNHNINIGVTAACSHAGKSSFYKNLLWLTEKDGSYPNLNKSYVNKKEKEVLVLWGVHHPSNIENQKTLYRKENAYVSVVSSNYNRRFTPEIAERPKVRGQAGRMNYYWTLLEPGDTIIFEANGNLIAPWYAFALSRGLGSGIITSNASMDECDTKCQTPQGAINSSLPFQNIHPFTIGECPKYVRSTKLRMVTGLRNIPSIQSRGLFGAIAGFIEGGWAGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 10098 - protein, 566 aa, Artificial Sequence; identical to SEQ ID NO: 1634
  hemagglutinin__InfluenzaA__AGO00289

SEQ ID NO: 10099 - protein, 565 aa, Artificial Sequence
  hemagglutinin__InfluenzaA__AGO00301
MKAKLLILLCALSATDADTICIGYHANNSTDTVDTVLEKNVTVTHSVNLLEDSHNGKLCRLKGKAPLQLGNCNIAGWVLGNPECESLLSNRSWSYIAETPNSENGTCYPGDFADYEELREQLSSVSSFERFEIFPKERSWPNHTTRGVTAACPHARKSSFYKNLVWLTEANGSYPNLSRSYVNNQEKEVLVLWGVHHPSNIEEQRALYRKDNAYVSVVSSNYNRRFTPEIAKRPKVRDQSGRMNYYWTLLEPGDTIIFEATGNLIAPWYAFALSRGPGSGIITSNAPLDECDTKCQTPQGAINSSLPFQNIHPVTIGECPKYVRSTKLRMVTGLRNIPSVQSRGLFGAIAGFIEGGWTGMMDGWYGYHHQNEQGSGYAADQKSTQNAINGITNKVNSVIEKMNTQFTAVGKEFNKLEKRMENLNKKVDDGFMDIWTYNAELLVLLENERTLDFHDSNVKNLYEKVKNQLRNNAKELGNGCFEFYHKCDNECMESVKNGTYDYPKYSEESKLNREKIDGVKLESMGVYRILAIYSTVASSLVLLVSLGAISFWMCSNGSLQCRICI

SEQ ID NO: 10100 - protein, 566 aa, Artificial Sequence
  hemagglutinin__InfluenzaA__AGO00313
MKTIIALSYIFCQVLAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQNGGSYACKRGPDNSFFSRLNWLYKSESTYPVLNVTMPNNDNFDKLYIWGVHHPSTDKEQTNLYVQASGRVTVSTKRSQQTIIPNVGSRPWVRGLSSGISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 10101 - protein, 567 aa, Artificial Sequence; identical to SEQ ID NO: 9097
  hemagglutinin__InfluenzaA__AGO00325

SEQ ID NO: 10102 - protein, 565 aa, Artificial Sequence
  hemagglutinin__InfluenzaA__AGO00337
MKANLLVLLSALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNVHPVTIGECPKYVRSAKLRMVTGLRNTPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10103 - protein, 565 aa, Artificial Sequence; identical to SEQ ID NO: 3278
  hemagglutinin__InfluenzaA__AGO00349

SEQ ID NO: 10104 - protein, 565 aa, Artificial Sequence
  hemagglutinin__InfluenzaA__AGO00373
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPDHNTNGVTAACSHEGKSSFYRNLLWLTEKESSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNMKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10105 - protein, 565 aa, Artificial Sequence
  hemagglutinin__InfluenzaA__AGO00385
MKANLLVLLCALAAADADTICIGYHANNSTDTVDTVLEKNVTVTHSVNLLEDSHNGKLCRLKGIAPLQLGKCNIAGWLLGNPECDPLLPVGSWSYIVETPNSENGICYPGDFIDYEELREQLSSVSSFERFEIFPKESSWPDHNTNGVTAACSHEGKSSFYRNLLWLTEKESSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10106 - protein, 565 aa, Artificial Sequence
  hemagglutinin__InfluenzaA__AGO00397
MKANLLVLLCALAAADADTICIGYHANNSTDTVDTVLEKNVTVTHSVNLLEDSHNGKLCRLKGIAPLQLGKCNIAGWLLGNPECDPLLPVGSWSYIVETPNSENGICYPGDFIDYEELREQLSSVSSFERFEIFPKESSWPDHNTNGVTAACSHEGKSSFYRNLLWLTEKESSYPKLKNSYVNKKGKEVLVLWGIHHPPNSKEQQNLYQNENAYVSVVTSNYNRRFTPEIAERPKVKDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10107 - protein, 565 aa, Artificial Sequence
  hemagglutinin__InfluenzaA__AGO00409
MKANLLVLLCALAAADADTICIGYHANNSTDTVDTVLEKNVTVTHSVNLLEDSHNGKLCRLKGIAPLQLGKCNIAGWLLGNPECDPLLPVGSWSYIVETPNSENGICYPGDFIDYEELREQLSSVSSFERFEIFPKESSWPDHNTNGVTAACSHEGKNSFYRNLLWLTEKKSSYPELKNSYVNKKGKEVLVLWGIHHPPNSKEQQNLYQNENAYVSVVTSNYNRRFTPEIAERPKVKDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10108 - protein, 565 aa, Artificial Sequence
  hemagglutinin__InfluenzaA__AGO00421
MKANLLVLLCALAAADADTICIGYHANNSTDTVDTVLEKNVTVTHSVNLLEDSHNGKLCKLKGIAPLQLGKCNIAGWLLGNPGCDPLLPVGSWSYIVETPNSENGICYPGDFIDYEELREQLSSVSSFERFKIFPKESSWPDHNTTGVTAACSHEGKNSFYRNLLWLTKKESSYPELKNSYVNKKRKEVLVLWGIHHPPNSKEQQNLYQNENAYVSVVTSNYNRRFTPEIAERPKVKGQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10109 - protein, 565 aa, Artificial Sequence
  hemagglutinin__InfluenzaA__AGO00433
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLENSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10110 - protein, 565 aa, Artificial Sequence
  hemagglutinin__InfluenzaA__AGO00445
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPTLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10111 - protein, 566 aa, Artificial Sequence
  hemagglutinin__InfluenzaA__AGO02696
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSISYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10112 - protein, 566 aa, Artificial Sequence; identical to SEQ ID NO: 10040
  hemagglutinin__InfluenzaA__AGO02697

SEQ ID NO: 10113 - protein, 566 aa, Artificial Sequence; identical to SEQ ID NO: 9858
  hemagglutinin__InfluenzaA__AGO02698

SEQ ID NO: 10114 - protein, 566 aa, Artificial Sequence; identical to SEQ ID NO: 9858
  hemagglutinin__InfluenzaA__AGO02699

SEQ ID NO: 10115 - protein, 566 aa, Artificial Sequence
  hemagglutinin__InfluenzaA__AGO02700
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPQAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPRYSEEAKLNREEIDGIKLESTRIYQILAIYSTVASSLVLIVSLGAISFWMCSNGSLQCRICI

SEQ ID NO: 10116 - protein, 566 aa, Artificial Sequence
  hemagglutinin__InfluenzaA__AGO02701
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSHFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNGQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10117 - protein, 560 aa, Artificial Sequence; identical to SEQ ID NO: 9988
  hemagglutinin__InfluenzaA__AGO51374

SEQ ID NO: 10118 - protein, 566 aa, Artificial Sequence
  hemagglutinin__InfluenzaA__AGO86686
MKTIIALSYILCLAFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLENRYPALNVTMPNNDKFDKLYIWGVHHPSTDSDQISVYAQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNKLIEKTNEKFHQIEKEFSEVEGRIQDLEKYVEDTKIDLWSYNAELLVALENQHTIDLTDSEMNKLFERTRKQLRENAEDMGNGCFKTYHKCDNACIGSIRNGTYDHDVYRDEALNNRFQIKGVELKSGYKDWILWISFAISCFLLCVVLLGFIMWACQKGNIRCNICI

SEQ ID NO: 10119 - protein, 566 aa, Artificial Sequence; identical to SEQ ID NO: 10040
  hemagglutinin__InfluenzaA__AGQ16240

SEQ ID NO: 10120 - protein, 566 aa, Artificial Sequence; identical to SEQ ID NO: 10040
  hemagglutinin__InfluenzaA__AGQ16241

SEQ ID NO: 10121 - protein, 566 aa, Artificial Sequence
  hemagglutinin__InfluenzaA__AGQ16242
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSTSYINDKGKEILVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10122 - protein, 566 aa, Artificial Sequence; identical to SEQ ID NO: 10060
  hemagglutinin__InfluenzaA__AGQ16243

SEQ ID NO: 10123 - protein, 566 aa, Artificial Sequence
  hemagglutinin__InfluenzaA__AGQ16245
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10124 - protein, 566 aa, Artificial Sequence; identical to SEQ ID NO: 10060
  hemagglutinin__InfluenzaA__AGQ16247

SEQ ID NO: 10125 - protein, 566 aa, Artificial Sequence
  hemagglutinin__InfluenzaA__AGQ16248
MQAILVVLLYTFATATADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPIHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10126 - protein, 566 aa, Artificial Sequence; identical to SEQ ID NO: 9858
  hemagglutinin__InfluenzaA__AGQ16329

SEQ ID NO: 10127 - protein, 566 aa, Artificial Sequence; identical to SEQ ID NO: 9883
  hemagglutinin__InfluenzaA__AGQ16331

SEQ ID NO: 10128 - protein, 566 aa, Artificial Sequence; identical to SEQ ID NO: 9858
  hemagglutinin__InfluenzaA__AGQ16332

SEQ ID NO: 10129 - protein, 566 aa, Artificial Sequence; identical to SEQ ID NO: 9858
  hemagglutinin__InfluenzaA__AGQ16333

SEQ ID NO: 10130 - protein, 566 aa, Artificial Sequence
  hemagglutinin__InfluenzaA__AGQ16335
MKTIIALSYILCLVFAQKLPGNDNSTATLCLGHHAVPNGTIVKTITNDRIEVTNATELVQNSSIGEICDSPHQVLDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10131 - protein, 566 aa, Artificial Sequence
  hemagglutinin__InfluenzaA__AGQ16336
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNRSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10132 - protein, 566 aa, Artificial Sequence; identical to SEQ ID NO: 10130
  hemagglutinin__InfluenzaA__AGQ16337

SEQ ID NO: 10133 - protein, 566 aa, Artificial Sequence; identical to SEQ ID NO: 9868
  hemagglutinin__InfluenzaA__AGQ16338

SEQ ID NO: 10134 - protein, 566 aa, Artificial Sequence
  hemagglutinin__InfluenzaA__AGQ16339
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKNWILWISFAISCFLLCVALLGFIMWACQKGNIRCNICI

SEQ ID NO: 10135 - protein, 566 aa, Artificial Sequence; identical to SEQ ID NO: 9994
  hemagglutinin__InfluenzaA__AGQ16340

SEQ ID NO: 10136 - protein, 566 aa, Artificial Sequence; identical to SEQ ID NO: 9858
  hemagglutinin__InfluenzaA__AGQ16341

SEQ ID NO: 10137 - protein, 566 aa, Artificial Sequence; identical to SEQ ID NO: 9868
  hemagglutinin__InfluenzaA__AGQ16342

SEQ ID NO: 10138 - protein, 566 aa, Artificial Sequence
  hemagglutinin__InfluenzaA__AGQ16343
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10139 - protein, 566 aa, Artificial Sequence; identical to SEQ ID NO: 9868
  hemagglutinin__InfluenzaA__AGQ16344

SEQ ID NO: 10140 - protein, 566 aa, Artificial Sequence; identical to SEQ ID NO: 9858
  hemagglutinin__InfluenzaA__AGQ16345

SEQ ID NO: 10141 - protein, 566 aa, Artificial Sequence
  hemagglutinin__InfluenzaA__AGQ16346
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCRSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10142 - protein, 566 aa, Artificial Sequence; identical to SEQ ID NO: 9858
  hemagglutinin__InfluenzaA__AGQ16347

SEQ ID NO: 10143 - protein, 566 aa, Artificial Sequence; identical to SEQ ID NO: 9994
  hemagglutinin__InfluenzaA__AGQ16348

SEQ ID NO: 10144 - protein, 566 aa, Artificial Sequence; identical to SEQ ID NO: 9858
  hemagglutinin__InfluenzaA__AGQ16349

SEQ ID NO: 10145 - protein, 566 aa, Artificial Sequence
  hemagglutinin__InfluenzaA__AGQ16350
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWTCQKGNIRCNICI

SEQ ID NO: 10146 - protein, 566 aa, Artificial Sequence
  hemagglutinin__InfluenzaA__AGQ47719
MKAILLVLLCTFTATNADTLCIGYHANNSTDTVDTVLEKNVTVTHSVNLLEDRHNGKLCKLGGIAPLHLGKCNIAGWLLGNPECELLFTVSSWSYIVETSNSDNGTCYPGDFINYEELREQLSSVSSFERFEIFPKTSSWPDHETNRGVTAACPYAGANSFYRNLIWLVKKGNSYPKLSKSYVNNKGKEVLVLWGIHHPPTSTDQQSLYQNADAYVFVGSSKYNRKFKPEIAARPKVRGQAGRMNYYWTLIEPGDTITFEATGNLVVPRYAFAMNRGSGSGIIISDAPIHDCNTKCQTPKGAINTSLPFQNIHPVTIGECPKYVKSTKLRMATGLRNIPSIQSRGLFGAIAGFIEGGWTGMIDGWYGYHHQNGQGSGYAADQKSTQNAIDGITNKVNSVIEKMNTQFTAVGKEFNHLEKRIENLNKKVDDGFLDVWTYNAELLVLLENERTLDFHDSNVKNLYEKVRSQLRNNAKEIGNGCFEFYHKCDDTCMESVKNGTYDYPKYSEESKLNREEIDGVKLESTRIYQILAIYSTAASSLVLLVSLGAISFWMCSNGSLQCRICI

SEQ ID NO: 10147 - protein, 565 aa, Artificial Sequence; identical to SEQ ID NO: 2115
  hemagglutinin__InfluenzaA__AGQ47728

SEQ ID NO: 10148 - protein, 566 aa, Artificial Sequence
  hemagglutinin__InfluenzaA__AGQ47740
MKARLLVLLCALAATDADTICIGYHANNSTDTVDTLLEKNVTVTHSVNLLEDSHNGKLCKLKGIAPLQLGKCNIAGWLLGNPECDSLLPARSWSYIVETPNSENGACYPGDFIDYEELREQLSSVSSLERFEIFPKESSWPNHNTIKGVTASCSHRGQSSFYRNLLWLTKKGDSYPKLNNSYVNNKGKEVLVLWGVHHPSSSNEQQSLYRNENAYVSVVSSNYNRRFTPEIAARPKVRDQTGRMNYYWTLLEPGDTIMFEATGNLIAPWYAFALSRGFGSGIITSNASMHECNTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDLNVKNLYEKVKSQLKNNAKEIGNGCFEFYHKCDNECMESVRNGTYDYPKYSEESKLNREKIDGVKLESMGVYQILAIYSTVASSLVLLVSLGAISFWMCSNGSLQCRICI

SEQ ID NO: 10149 - protein, 566 aa, Artificial Sequence
  hemagglutinin__InfluenzaA__AGQ47752
MKAKLLILLCALSATDADTICIGYHANNSTDTVDTVLEKNVTVTHSVNLLEDSHNGKLCRLKGKAPLQLGKCNIAGWVLGNPECESLLSNRSWSYIAETPNSENGICYPGDFADYEELREQLSSVSSFERFEIFPKERSWPKHNTIRGVTAACSHAGKSSFYKNLVWLTEANGSYPALSTSYVNNQEKEVLVLWGVHHPSNIEEQRTLYRKDNAYVSVVSSNYNRRFTPEIAKRPKVRDQPGRMNYYWTLLEPGDTIIFEATGNLIAPWYAFALSRGPGSGIITSNAPMDECDTKCQTPQGAINSSLPFQNIHPVTIGECPKYVRSTKLRMVTGLRNIPSIQSRGLFGAIAGFIEGGWTGMMDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKELGNGCFEFYHKCDNECMESVKNGTYDYPKYSEESKLNREKIDGVKLESMGVYRILAIYSTVASSLVLLVSLGAISFWMCSNGSLQCRICI

SEQ ID NO: 10150 - protein, 566 aa, Artificial Sequence
  hemagglutinin__InfluenzaA__AGQ47764
MKAKLLILLCALTATDADTICIGYHANNSTDTVDTVLEKNVTVTHSVNLLEDSHNGKLCRLKGIAPLQLGKCNIAGWILGNPECESLLSKRSWSYIAETPNSENGACYPGDFADYEELREQLSSVSSFERFEIFPKERSWPKHNITRGVTAACSHAGKSSFYKNLLWLTETDGSYPKLSKSYVNNKEKEVLVLWGVHHPSNIEDQKTLYRKENAYVSVVSSNYNRRFTPEIAERPKVRGQAGRINYYWTLLEPGDTIIFEANGNLIAPWYAFALSRDFGSGIITSNASMDECDTKCQTPQGAINSSLPFQNIHPVTIGECPKYVKSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 10151 - protein, 566 aa, Artificial Sequence
  hemagglutinin__InfluenzaA__AGQ47776
MKAKLLILLCALSATDADTICIGYHANNSTDTVDTVLEKNVTVTHSVNLLEDSHNGKLCRLKGIAPLQLGKCNIAGWILGNPECESLLSKRSWSYIAETPNSENGTCYPGDFADYEELREQLSSVSSFERFEIFPKERSWPKHNINIGVTAACSHAGKSSFYKNLLWLTEKDGSYPNLNKSYVNKKEKEVLVLWGVHHPSNIEDQKTLYRKENAYVSVVSSNYNRRFTPEIAERPKVRGQAGRMNYYWTLLEPGDTIIFEANGNLIAPWYAFALSRGLGSGIITSNASMDECDTKCQTPQGAINSSLPFQNIHPFTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 10152 - protein, 566 aa, Artificial Sequence
  hemagglutinin__InfluenzaA__AGQ47788
MKAKLLVLLCALSATDADTICIGYHANNSTDTVDTVLEKNVTVTHSVNLLEDSHNGKLCRLKGIAPLQLGKCNIAGWILGNPECESLFSKKSWSYIAETPNSENGTCYPGYFADYEELREQLSSVSSFERFEIFPKERSWPKHNVTRGVTAACSHKGKSSFYRNLLWLTEKDGSYPNLSKSYVNNKEKEVLVLWGVHHPSNIEDQKTLYRKENAYVSVVSSNYNRRFTPEIAERPKVRGQAGRINYYWTLLEPGDTIIFEANGNLIAPWHAFALSRGFGSGIITSNASMDECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 10153 - protein, 566 aa, Artificial Sequence
  hemagglutinin__InfluenzaA__AGQ47800
MKARLLVLLCALAATDADTICIGYHANNSTDTVDTILEKNVTVTHSVNLLEDSHNGKLCRLKGIAPLQLGKCNIAGWILGNPECESLLSERSWSYIVEIPNSENGTCYPGDFTDYEELREQLSSVSSFERFEIFPKESSWPKHNTARGVTAACSHAGKSSFYRNLLWLTEKDGSYPNLKNSYVNKKGKEVLVLWGVHHPSSIKEQQTLYQKENAYVSVVSSNYNRRFTPEIAERPKVRDQAGRMNYYWTLLEPGDTIIFEANGNLIAPWYAFALSRGFGSGIITSNASMHECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLILLENERTLDFHDSNVKNLYEKVKSQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 10154 - protein, 566 aa, Artificial Sequence
  hemagglutinin__InfluenzaA__AGQ47811
MKAKLLVLLCALSATDADTICIGYHANNSTDTVDTVLEKNVTVTHSVNLLEDSHNGKLCRLKGIAPLQLGKCNIAGWILGNPECESLFSKKSWSYIAETPNSENGTCYPGFFADYEELREQLSSVSSFERFEIFPKERSWPKHNVTRGVTAACSHKGKSSFYRNLLWLTEKNGSYPNLSKSYVNNKEKEVLVLWGVHHPSNIEDQKTIYRKENAYVSVVSSNYNRRFTPEIAERPKVRGQAGRINYYWTLLEPGDTIIFEANGNLIAPWHAFALSRGFGSGIITSNASMDECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 10155 - protein, 566 aa, Artificial Sequence
  hemagglutinin__InfluenzaA__AGQ47823
MKAKLLVLLCAFTATYADTICIGYHANNSTDTVDTVLEKNVTVTHSVNLLEDSHNGKLCRLKGIAPLQLGNCSVAGWILGNPKCESLFSKESWSYIAETPNPENGTCYPGYFADYEELREQLSSVSSFERFEIFPKESSWPNHTVTKGVTTSCSHNGKSSFYRNLLWLTEKNGLYPNLSKSYVNNKEKEVLVLWGVHHPSNIRDQRAIYHTENAYVSVVSSHYSRRFTPEIAKRPKVRGQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENGRTLDFHDSNVKNLYEKVKSQLKNNAKEIGNGCFEFYHKCNNECMESVKNGTYDYPKYSEESKLNRGKIDGVKLESMGVYQILAIYSTVASSLVLLVSLGAISFWMCSNGSLQCRICI

SEQ ID NO: 10156 - protein, 566 aa, Artificial Sequence
  hemagglutinin__InfluenzaA__AGQ47835
MKTIIALSYIFCLVLGQDFPGNDNSTATLCLGHHAVPNGTIVKTITNDQIEVTNATELVQSSSTGKICNNPHRILDGINCTLIDALLGDPHCDGFQNETWDLFVERSKAFSNCYPYYVPDYASLRSLVASSGTLEFINEGFNWTGVTQNGGSNACKRGPNSGFFSRLNWLYKSGTTYPVLNVTMPNNDNFDKLYIWGVHHPSTDQEQTNLYVQASGRVTVSTKRSQQTITPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 10157 - protein, 566 aa, Artificial Sequence
  hemagglutinin__InfluenzaA__AGQ47847
MKARLLILLCALAATDADTICIGYHANNSTDTVDTVLEKNVTVTHSVNLLEDSHNGKLCRLKGIAPLQLGKCNIAGWLLGNPECDSLLPASSWSYIVETPNSKNGICYPGDFIDYEELREQLSSVSSFERFEIFPKESSWPKHNTTKGVTAACSHAGKSSFYRNLLWLTKKEDSYPKLSNSYVNKKGKEVLVLWGVHHPSNSKEQQTLYQNENAYVSVVSSNYNRRFTPEIAERPKVRDQAGRMNYYWTLLEPGDTIIFEANGNLIAPWYAFALSRGFGSGIITSNASMHECNTKCQTPQGAINSSLPFQNIHPVTIGECPKYVKSAKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKIQLKNNAKEIGNGCFEFYHKCDNECMESVRNGTYDYPKYSKESKLNREKIDGVKLEPMGVYQILAIYSTVASSLVLLVSLGAISFWMCSNGSLQCRICI

SEQ ID NO: 10158 - protein, 566 aa, Artificial Sequence
  hemagglutinin__InfluenzaA__AGQ47870
MKAILLVLLCTFAATNADTLCIGYHANNSTDTVDTVLEKNVTVTHSVNLLEDRHNGKLCKLGGIAPLHLGKCNIAGWLLGNPECELLLTVSSWSYIVETSNSDNGTCYPGDFINYEELREQLSSVSSFERFEIFPKTSSWPNHETNRGVTAACPYAGANSFYRNLIWLVKKGNSYPKLSKSYVNNKGKEVLVLWGIHHPPTSTDQQSLYQNADAYVFVGSSKYNRKFKPEIAARPKVRGQAGRMNYYWTLIEPGDTITFEATGNLVVPRYAFAMNRGSGSGIIISDAPVHDCNTKCQTPKGAINTSLPFQNIHPVTIGECPKYVKSTKLRMATGLRNIPSIQSRGLFGAIAGFIEGGWTGMIDGWYGYHHQNEQGSGYAADQRSTQNAIDGITNKVNSVIEKMNTQFTAVGKEFNHLEKRIENLNKKVDDGFLDIWTYNAELLVLLENERTLDFHDSNVKNLYEKVRSQLRNNAKEIGNGCFEFYHKCDDTCMESVKNGTYDYPKYSEESKLNREEIDGVKLESTRIYQILAIYSTVASSLVLLVSLGAISFWMCSNGSLQCRICI

SEQ ID NO: 10159 - protein, 566 aa, Artificial Sequence
  hemagglutinin__InfluenzaA__AGQ47882
MKAILLVLLCTFAATNADTLCIGYHANNSTDTVDTVLEKNVTVTHSVNLLEDRHNGKLCKLGGIAPLHLGKCNIAGWLLGNPECELLLTVSSWSYIVETSNSDNGTCYPGDFINYEELREQLSSVSSFERFEIFPKTSSWPNHETNRGVTAACPYAGANSFYRNLIWLVKKENSYPKLSKSYVNNKGKEVLVLWGIHHPPTSTDQQSLYQNADAYVFVGSSKYNRKFKPEIAARPKVRGQAGRMNYYWTLIEPGDTITFEATGNLVVPRYAFAMNRGSGSGIIISDAPVHDCNTKCQTPKGAINTSLPFQNIHPVTIGECPKYVKSTKLRMATGLRNIPSIQSRGLFGAIAGFIEGGWTGMIDGWYGYHHQNEQGSGYAADQRSTQNAIDGITNKVNSVIEKMNTQFTAVGKEFNHLEKRIENLNKKVDDGFLDIWTYNAELLVLLENERTLDFHDSNVKNLYEKVRSQLRNNAKEIGNGCFEFYHKCDDTCMESVKNGTYDYPKYSEESKLNREEIDGVKLESTRIYQILAIYSTVASSLVLLVSLGAISFWMCSNGSLQCRICI

SEQ ID NO: 10160 - protein, 566 aa, Artificial Sequence; identical to SEQ ID NO: 9095
  hemagglutinin__InfluenzaA__AGQ47894

SEQ ID NO: 10161 - protein, 566 aa, Artificial Sequence
  hemagglutinin__InfluenzaA__AGQ47906
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 10162 - protein, 566 aa, Artificial Sequence
  hemagglutinin__InfluenzaA__AGQ47918
MKTIIALSYIFCLALGQDLPGNDNNTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 10163 - protein, 566 aa, Artificial Sequence
  hemagglutinin__InfluenzaA__AGQ47930
MKANLLVLLCALAAADADTICIGYHANNSTDTVDTALEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNKGVTAACSHAGKSSFYRNLLWLTEKEGSYPKLKNSYVNKKGKEVLVLWGIHHPSNSKDQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPFQNIHPVTIGECPKYVRSAKLRMVTGLRNIPSIQSRGLFGAIAGFIEGGWTGMIDGWYGYHHQNEQGSGYAADQKSTQNAINGITNKVNSVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10164 - protein, 565 aa, Artificial Sequence; identical to SEQ ID NO: 3278
  hemagglutinin__InfluenzaA__AGQ47942

SEQ ID NO: 10165 - protein, 565 aa, Artificial Sequence
  hemagglutinin__InfluenzaA__AGQ47954
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYRNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10166 - protein, 565 aa, Artificial Sequence
  hemagglutinin__InfluenzaA__AGQ47966
MKANLLVLLCALAAADADTICIGYHANNSTDTVDTVLEKNVTVTHSVNLLEDSHNGKLCRLKGIAPLQLGKCNIAGWLLGNPECDPLLPVGSWSYIVETPNSENGICYPGDFIDYEELREQLSSVSSFERFEIFPKESSWPDHNTNGVTAACSHEGKNSFYRNLLWLTEKESSYPKLKNSYVNKKGKEVLVLWGIHHPPNSKEQQNLYQNENAYVSVVTSNYNRRFTPEIAERPKVKDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10167 - protein, 565 aa, Artificial Sequence
  hemagglutinin__InfluenzaA__AGQ47978
MKANLLVLLCALAAADADTICIGYHANNSTDTVDTVLEKNVTVTHSVNLLEDSHNGKLCRLKGIAPLQLGKCNIAGWLLGNPECDPLLPVGSWSYIVETPNSENGICYPGDFIDYEELREQLSSVSSFERFEIFPKESSWPDHNTNGVTAACSHEGKNSFYRNLLWLTKKESSYPELKNSYVNKKGKEVLVLWGIHHPPNSKEQQNLYQNENAYVSVVTSNYNRRFTPEIAERPKVKDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10168 - protein, 565 aa, Artificial Sequence
  hemagglutinin__InfluenzaA__AGQ47990
MKANLLVLLCALAAADADTICIGYHANNSTDTVDTVLEKNVTVTHSVNLLEDSHNGKLCRLKGIAPLQLGKCNIAGWLLGNPECDPLLPVGSWSYIVETPNSENGICYPGDFIDYEELREQLSSVSSFERFKIFPKESSWPDHNTNGVTAACSHEGKNSFYRNLLWLTKKESSYPELKNSYVNKKGKEVLVLWGIHHPPNSKEQQNLYQNENAYVSVVTSNYNRRFTPEIAERPKVKDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10169 - protein, 565 aa, Artificial Sequence
  hemagglutinin__InfluenzaA__AGQ48002
MKANLLVLLCALAAADADTICIGYHANNSTDTVDTVLEKNVTVTHSVNLLEDSHNGKLCRLKGIAPLQLGKCNIAGWLLGNPECDPLLPVGSWSYIVETPNSENGICYPGDFIDYEELREQLSSVSSFERFKIFPKESSWPDHNTNGVTAACSHEGKNSFYRNLLWLTKKESSYPELKNSYVNKKRKEVLVLWGIHHPPNSKEQQNLYQNENAYVSVVTSNYNRRFTPEIAERPKVKDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10170 - protein, 565 aa, Artificial Sequence
  hemagglutinin__InfluenzaA__AGQ48014
MKANLLVLLCALAAADADTICIGYHANNSTDTVDTVLEKNVTVTHSVNLLEDSHNGKLCRLKGIAPLQLGKCNIAGWLLGNPGCDPLLPVGSWSYIVETPNSENGICYPGDFIDYEELREQLSSVSSFERFKIFPKESSWPDHNTNGVTAACSHEGKNSFYRNLLWLTKKESSYPELKNSYVNKKRKEVLVLWGIHHPPNSKEQQNLYQNENAYVSVVTSNYNRRFTPEIAERPKVKDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10171 - protein, 565 aa, Artificial Sequence
  hemagglutinin__InfluenzaA__AGQ48026
MKANLLVLLCALAAADADTICIGYHANNSTDTVDTVLEKNVTVTHSVNLLEDSHNGKLCKLKGIAPLQLGKCNIAGWLLGNPGCDPLLPVGSWSYIVETPNSENGICYPGDFIDYEELREQLSSVSSFERFKIFPKESSWPDHNTNGVTAACSHEGKNSFYRNLLWLTKKESSYPELKNSYVNKKRKEVLVLWGIHHPPNSKEQQNLYQNENAYVSVVTSNYNRRFTPEIAERPKVKDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10172 - protein, 565 aa, Artificial Sequence
  hemagglutinin__InfluenzaA__AGQ48038
MKANLLVLLCALAAADADTICIGYHANNSTDTVDTVLEKNVTVTHSVNLLEDSHNGKLCKLKGIAPLQLGKCNIAGWLLGNPGCDPLLPVGSWSYIVETPNSENGICYPGDFIDYEELREQLSSVSSFERFKIFPKESSWPDHNTNGVTAACSHEGKNSFYRNLLWLTKKESSYPELKNSYVNKKREEVLVLWGIHHPPNSEEQQNLYQNENAYVSVVTSNYNRRFTPEIAERPKVKGQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10173 - protein, 565 aa, Artificial Sequence
  hemagglutinin__InfluenzaA__AGQ48050
MKANLLVLLCALAAADADTICIGYHANNSTDTVDTVLEKNVTVTHSVNLLEDSHNGKLCKLKGIAPLQLGKCNIAGWLLGNPGCDPLLPVGSWSYIVETPNSENGICYPGDFIDYEELREQLSSVSSFERFKIFPKESSWPDHNTNGVTAACSHEGKNSFYRNLLWLTKKESSYPELKNSYVNKKREEVLVLWGIHHPPDSEEQQNLYQNENAYVSVVTSNYNRRFTPEIAERPKVKGQAGRMNYYWTLLKPGDTIIFKANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 10174 - protein, 562 aa, Artificial Sequence
  hemagglutinin__InfluenzaA__AGQ80946
MAIIYLILLFTAVRGDQICIGYHSNNSTEKVDTILERNVTVTHAQDILEKTHNGKLCKLNGIPPLELGDCSIAGWLLGNPECDRLLTVPEWSYIMEKENPRNGLCYPGSFNDYEELKHLLSSVTHFEKVKILPKDRWTQHTTTGGSRACAVSGNPSFFRNMVWLTKKGPNYPVAKGSYNNTSGDQMLIIWGVHHPNDEAEQRTLYQNVGTYVSVGTSTLNKRSVPEIATRPKVNGQGGRMEFSWTILDVLDTINFESTGNLIAPEYGFKISKRGSSGIMKTEGTLENCETKCQTPLGAINTTLPFHNIHPLTIGECPKYVKSERLVLATGLRNVPQIESRGLFGAIAGFIEGGWQGMVDGWYGYHHSNDQGSGYAADKESTQKAIDGITNKVNSVIEKMNTQFEAVGKEFSNLEKRLENLNKKMEDGFLDVWTYNAELLVLMENERTLDFHDSNVKNLYDKVRMQLRDNAKELGNGCFEFYHKCDDECMNSVKNGTYDYPKYEEESKLNRNEIKGVKLSNMGVYQILAIYATVAGSLSLAIMIAGISLWMCSNGSLQCRICI

SEQ ID NO: 10175 - protein, 562 aa, Artificial Sequence
  hemagglutinin__InfluenzaA__AGQ80947
MAIIYLILLFATVRGDQICIGYHSNNSTEKVDTILERNITVTHAQDILEKTHNGKLCKLNGIPPLELGNCSIAGWLLGNPECDRLLTVPEWSYIMEKENPRDGLCYPGSFNDYEELKHLLSSVTHFEKVKILPKDRWTQHTTTGGSRACAVSGNPSFFRNMVWLTKKGSNYPIAKGSYNNTSGEQMLIIWGVHHPNDDAEQRTLYQNVGTYVSVGTSTLNKRSIPEIATRPKVNGQGGRMEFSWTILDMLDTINFESTGNLIAPEYGFKISKRGSSGIMKTEGTLENCETKCQTPLGAINTTLPFHNIHPLTIGECPKYVKSERLVLATGLRNVPQIESRGLFGAIAGFIEGGWQGMVDGWYGYHHSNDQGSGYAADKESTQKAIDGITNKVNSVIEKMNTQFEAVGKEFNNLEKRLENLNKKMEDGFLDVWTYNAELLVLMENERTLDFHDSNVKNLYDKVRMQLKDNAKELGNGCFEFYHKCDDECMNSVKNGTYDYPKYEEESKLNRNEIKGVKLSNMGVYQILAIYATVAGSLSLAIMIAGVSLWMCSNGSLQCRICI

SEQ ID NO: 10176 - protein, 562 aa, Artificial Sequence
  hemagglutinin__InfluenzaA__AGQ80948
MAIIYLILLFAAVRGDQICIGYHSNNSTEKVDTILERNVTVTHAQDILEKTHNGKLCKLNGIPPLELGNCSIAGWLLGNPECDRLLTVPEWSYIMEKENPRNGLCYPGSFNDYEELKHLLSSVTHFEKVKILPKDRWTQHTTTGGSRACAVFGNPSFFRNMVWLTKKGSNYPIAKGSYNNTSGEQMLIIWGVHHPNDDAEQRTLYQNVGTYVSVGTSTLNKRSIPEIATRPKVNGQGGRMEFSWTILDMLDTINFESTGNLIAPEYGFKISKRGSSGIMKTEGTLENCETKCQTPLGAINTTLPFHNIHPLTIGECPKYVKSERLVLATGLRNVPQIESRGLFGAIAGFIEGGWQGMVDGWYGYHHSNDQGSGYAADKESTQKAIDGITNKVNSVIEKMNTQFEAVGKEFNNLEKRLENLNKKMEDGFLDVWTYNAELLVLMENERTLDFHDSNVKNLYDKIRMQLKDNAKELGNGCFEFYHKCDDECMNSVKNGTYDYPKYEEESKLNRNEIKGVKLSNMGVYQILAIYATVAGSLSLAIMIAGISLWMCSNGSLQCRICI

SEQ ID NO: 10177 - protein, 562 aa, Artificial Sequence
  hemagglutinin__InfluenzaA__AGQ80949
MAIIYLILLFAAVRGDQICIGYHSNNSTEKVDTILERNVTVTHAQDILEKTHNGKLCKLNGIPPLELGDCSIAGWLLGNPECDRLLTVPEWSYIMEKENPRNGLCYPGSFNDYEELKHLLSSVTHFEKVKILPKDRWTQHTTTGGSRACAVSGNPSFFRNMVWLTKKGSNYPIAKGSYNNTSGEQMLIIWGVHHPNDDAEQRTLYQNVGTYVSVGTSTLNKRSIPEIATRPKVNGQGGRMEFSWTILDMLDTINFESTGNLIAPEYGFKISKRGSSGIMKTEGTLENCETKCQTPLGAINTTLPFHNIHPLTIGECPKYVKSERLVLATGLRNVPQIESRGLFGAIAGFIEGGWQGMVDGWYGYHHSNDQGSGYAADKESTQKAIDGITNKVNSVIEKMNTQFEAVGKEFNNLEKRLENLNKKMEDGFLDVWTYNAELLVLMENERTLDFHDSNVKNLYDKIRMQLKDNAKELGNGCFEFYHKCDDECMNSVKNGTYDYPKYEEESKLNRNEIKGVKLSNMGVYQILAIYATVAGSLSLAIMIAGISLWMCSNGSLQCRICI

SEQ ID NO: 10178 - protein, 566 aa, Artificial Sequence
  hemagglutinin__InfluenzaA__AGQ80950
MKTIIALSYIFCLAFGQNLPGNDSSTATLCLGHHAVLNGTIVKTITDDQIEVTNATELVQSSSTGKICNNPHKILDGRDCTLIDALLGDPHCDVFQDETWDLFVERSSAFSNCYPYDVPDYASLRSLVASSGTLEFITEGFTWTGVSQNGGSGACKRGPANGFFSRLNWLTKSGNAYPVLNVTMPNSDNFDKLYIWGVHHPSTNQEQTNLYVQASGRVTVSTRRSQQTIIPNIGSRPWVRGQSGRISIYWTIVKPGDVLVINSNGNLIAPRGYFKMRTGKSSIMRSDAPIETCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDIYRDEALNNRFQIKGVELKSGYKDWILWISFAISCFLLCVVLLGFIMWACQRGNIRCNICI

SEQ ID NO: 10179 - protein, 564 aa, Artificial Sequence
  hemagglutinin__InfluenzaA__AGQ80951
MLSIVILFLLVAESSSQNYTGNPVICMGHHAVANGTMVKTLTDDQVEVVTAQELVESQNLPELCPSPLRLVDGQTCDIINGALGSPGCDHLNGAEWDIFIERPNAMDTCYPFDVPDYQSLRSILANNGKFEFIAEEFQWSTVKQNGKSGACKRANVNDFFNRLNWLVKSDGNAYPLQNLTKVNNGDYARLYIWGVHHPSTDTEQTNLYKNNPGRVTVSTKTSQTSVVPNIGSRPWVRGQSGRISFYWTIVEPGDLIVFNTIGNLIAPRGHYKLNSQKKSTILNTATPIGSCVSKCHTDKGSLSTTKPFQNISRVAIGDCPKYVKQGSLKLATGMRNIPEKASRGLFGAIAGFIENGWQGLIDGWYGFRHQNAEGTGTAADLKSTQAAIDQINGKLNRLIEKTNEKYHQIEKEFEQVEGRIQDLEKYVEDTKIDLWSYNAELLVALENQHTIDVTDSEMNKLFERVRRQLRENAEDKGNGCFEIFHKCDNNCIESIRNGTYDHDVYRNEAINNRFQIQGVKLTQGYKDIILWISFSISCFLLVALLLAFILWACQNGNIRCQICI

SEQ ID NO: 10180 - protein, 560 aa, Artificial Sequence
  hemagglutinin__InfluenzaA__AGQ80953
MNTQILVFALVAIIPTNADKICLGHHAVSNGTKVNTLTERGVEVVNATETVERTSIPRICSKGKRAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10181 - protein, 560 aa, Artificial Sequence; identical to SEQ ID NO: 10180
  hemagglutinin__InfluenzaA__AGQ80954

SEQ ID NO: 10182 - protein, 560 aa, Artificial Sequence; identical to SEQ ID NO: 10180
  hemagglutinin__InfluenzaA__AGQ80955

SEQ ID NO: 10183 - protein, 560 aa, Artificial Sequence; identical to SEQ ID NO: 10180
  hemagglutinin__InfluenzaA__AGQ80956

SEQ ID NO: 10184 - protein, 560 aa, Artificial Sequence; identical to SEQ ID NO: 10180
  hemagglutinin__InfluenzaA__AGQ80957

SEQ ID NO: 10185 - protein, 560 aa, Artificial Sequence; identical to SEQ ID NO: 10180
  hemagglutinin__InfluenzaA__AGQ80958

SEQ ID NO: 10186 - protein, 560 aa, Artificial Sequence
  hemagglutinin__InfluenzaA__AGQ80959
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKDPALIIWGIHHSGSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHGGGTIISNLPFQNIDSRAVGKCPRYVKQKSLLLATGMKNVPESPKGRGLFGAIAGFIENGWEGLIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10187 - protein, 560 aa, Artificial Sequence
  hemagglutinin__InfluenzaA__AGQ80961
MNTQILVFALVAIIPTNADKICLGHHAVSNGTKVNTLTERGVEVVNATETVERTNVPKICSKGKRTVDLGQCGLLGTITGPPQCDQFLEFSADLIIERREGSDVCYPGKFVNEETLRQILRESGGIDKETMGFTYSGIRTNGATSACRRSGSSFYAEMKWLLSNTDNAAFPQMTKSYKNARKDPALIIWGIHHSGSTTEQTKLYGSGNKLITVGSSNYQQSFVPSPGARPQVNGQSGRIDFHWLMLNPNDTVTFSFNGAFIAPDRACFLRGKSMGIQSGVQVDASCEGDCYHSGGTIISNLPFQNINSRAVGKCPRYVKQESLMLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIKIDPVKLSSGYKDVILWFSFGASCFILLAIAMGLVFICVKNGNMRCTICI

SEQ ID NO: 10188 - protein, 560 aa, Artificial Sequence; identical to SEQ ID NO: 10187
  hemagglutinin__InfluenzaA__AGQ80962

SEQ ID NO: 10189 - protein, 560 aa, Artificial Sequence
  hemagglutinin__InfluenzaA__AGQ80964
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKDPALIIWGIHHSGSTAEQTKLYGSGNKLVTVGSSNYQQSFVPSPGARPQVNGQSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10190 - protein, 560 aa, Artificial Sequence; identical to SEQ ID NO: 10180
  hemagglutinin__InfluenzaA__AGQ80965

SEQ ID NO: 10191 - protein, 560 aa, Artificial Sequence; identical to SEQ ID NO: 10180
  hemagglutinin__InfluenzaA__AGQ80966

SEQ ID NO: 10192 - protein, 560 aa, Artificial Sequence; identical to SEQ ID NO: 10180
  hemagglutinin__InfluenzaA__AGQ80968

SEQ ID NO: 10193 - protein, 560 aa, Artificial Sequence
  hemagglutinin__InfluenzaA__AGQ80970
MNTQILVFALVAIIPTNADKICLGHHAVSNGTKVNTLTERGVEVVNATETVERTSIPRICSKGKKAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10194 - protein, 560 aa, Artificial Sequence
  hemagglutinin__InfluenzaA__AGQ80971
MNTQILVFALVAIIPTNADKICLGHHAVSNGTKVNTLTERGVEVVNATETVERTSIPRICSKGKKTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10195 - protein, 560 aa, Artificial Sequence
  hemagglutinin__InfluenzaA__AGQ80974
MNTQILVFALVAIIPTNADKICLGHHAVSNGTKVNTLTERGVEVVNATETVERTSIPRICSKGKRAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLVDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10196 - protein, 560 aa, Artificial Sequence
  hemagglutinin__InfluenzaA__AGQ80977
MNTQILALALAAIIPTNADKICLGHHAVSNGTKVNTLTERGVEVVNATETVERTSIPRICSKGKRAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGVHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLVDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKSGNMRCTICI

SEQ ID NO: 10197 - protein, 560 aa, Artificial Sequence
  hemagglutinin__InfluenzaA__AGQ80978
MNTQILVFALVAIIPTNADKICLGHHAVSNGTKVNTLTERGVEVVNATETVERTSIPRICSKGKRAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSITEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLVDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10198 - protein, 560 aa, Artificial Sequence
  hemagglutinin__InfluenzaA__AGQ80979
MNTQILVFALVAIIPTNADKICLGHHAVSNGTKVNTLTERGVEVVNATETVERTSIPRICSKGKRAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSIGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10199 - protein, 560 aa, Artificial Sequence; identical to SEQ ID NO: 10195
  hemagglutinin__InfluenzaA__AGQ80980

SEQ ID NO: 10200 - protein, 560 aa, Artificial Sequence; identical to SEQ ID NO: 10180
  hemagglutinin__InfluenzaA__AGQ80981

SEQ ID NO: 10201 - protein, 560 aa, Artificial Sequence; identical to SEQ ID NO: 10180
  hemagglutinin__InfluenzaA__AGQ80982

SEQ ID NO: 10202 - protein, 560 aa, Artificial Sequence; identical to SEQ ID NO: 10180
  hemagglutinin__InfluenzaA__AGQ80983

SEQ ID NO: 10203 - protein, 560 aa, Artificial Sequence; identical to SEQ ID NO: 10180
  hemagglutinin__InfluenzaA__AGQ80984

SEQ ID NO: 10204 - protein, 560 aa, Artificial Sequence; identical to SEQ ID NO: 10180
  hemagglutinin__InfluenzaA__AGQ80985

SEQ ID NO: 10205 - protein, 560 aa, Artificial Sequence; identical to SEQ ID NO: 10180
  hemagglutinin__InfluenzaA__AGQ80986

SEQ ID NO: 10206 - protein, 560 aa, Artificial Sequence; identical to SEQ ID NO: 10180
  hemagglutinin__InfluenzaA__AGQ80987

SEQ ID NO: 10207 - protein, 560 aa, Artificial Sequence; identical to SEQ ID NO: 10180
  hemagglutinin__InfluenzaA__AGQ80988

SEQ ID NO: 10208 - protein, 560 aa, Artificial Sequence
  hemagglutinin__InfluenzaA__AGQ80990
MNTQILVFALVAIIPTNADKICLGHHAVSNGTKVNTLTERGVEVVNATETVERTSIPKICSKGKRAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10209 - protein, 560 aa, Artificial Sequence; identical to SEQ ID NO: 10194
  hemagglutinin__InfluenzaA__AGQ80991

SEQ ID NO: 10210 - protein, 560 aa, Artificial Sequence
  hemagglutinin__InfluenzaA__AGQ80992
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFMNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLMLNPNDTVTFSFNGAFIAPDRACFLRGKSMGIQSGVQVDASCEGDCYHSGGTIISNLPFQNINSRAVGKCPRYVKQESLMLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10211 - protein, 560 aa, Artificial Sequence; identical to SEQ ID NO: 10180
  hemagglutinin__InfluenzaA__AGQ80993

SEQ ID NO: 10212 - protein, 560 aa, Artificial Sequence; identical to SEQ ID NO: 10187
  hemagglutinin__InfluenzaA__AGQ80994

SEQ ID NO: 10213 - protein, 560 aa, Artificial Sequence; identical to SEQ ID NO: 10189
  hemagglutinin__InfluenzaA__AGQ80995

SEQ ID NO: 10214 - protein, 560 aa, Artificial Sequence; identical to SEQ ID NO: 10189
  hemagglutinin__InfluenzaA__AGQ80996

SEQ ID NO: 10215 - protein, 560 aa, Artificial Sequence
  hemagglutinin__InfluenzaA__AGQ80997
MNTQILVFALVAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKETMGFTYSGIRTDGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHSGGTIISNLPFQNINSRAVGKCPRYVKQESLLLATGMKNVPEIPKGRGLFGAIAGFIENGWEGLIDGWYGFRHQNSQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10216 - protein, 560 aa, Artificial Sequence
  hemagglutinin__InfluenzaA__AGQ81000
MNTQILVFALVAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIGKETMGFTYSGIRTNGATSACRRSGSSFYAEMKWLLSNTDNAAFPQMTKSYKNTRKDPALIIWGIHHSGSTTEQTKLYGSGNKLITVGSSNYQKSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10217 - protein, 560 aa, Artificial Sequence
  hemagglutinin__InfluenzaA__AGQ81001
MNTQILVFALVAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGTSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEIEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10218 - protein, 560 aa, Artificial Sequence; identical to SEQ ID NO: 10195
  hemagglutinin__InfluenzaA__AGQ81002

SEQ ID NO: 10219 - protein, 560 aa, Artificial Sequence; identical to SEQ ID NO: 10195
  hemagglutinin__InfluenzaA__AGQ81003

SEQ ID NO: 10220 - protein, 560 aa, Artificial Sequence; identical to SEQ ID NO: 10195
  hemagglutinin__InfluenzaA__AGQ81004

SEQ ID NO: 10221 - protein, 560 aa, Artificial Sequence; identical to SEQ ID NO: 10195
  hemagglutinin__InfluenzaA__AGQ81005

SEQ ID NO: 10222 - protein, 560 aa, Artificial Sequence; identical to SEQ ID NO: 10195
  hemagglutinin__InfluenzaA__AGQ81006

SEQ ID NO: 10223 - protein, 560 aa, Artificial Sequence; identical to SEQ ID NO: 10195
  hemagglutinin__InfluenzaA__AGQ81007

SEQ ID NO: 10224 - protein, 560 aa, Artificial Sequence; identical to SEQ ID NO: 10195
  hemagglutinin__InfluenzaA__AGQ81008

SEQ ID NO: 10225 - protein, 560 aa, Artificial Sequence
  hemagglutinin__InfluenzaA__AGQ81009
MNTQILVFALVAIIPTNADKICLGHHAVSNGTKVNTLTERGVEVVNATETVERTSIPRICSKGKRAVDLGQCGLLGTITGPPQCDQFLEFSADLIIERQEGSDVCYPGKFVNEEALRQILRESGGINKETMGFTYSGIRTNGATSACRRSGSSFYAEMKWLLSNTDNAAFPQTTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLVDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10226 - protein, 560 aa, Artificial Sequence
  hemagglutinin__InfluenzaA__AGQ81011
MNTQILVFALIAITPTNSDKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGIDKEAMGFTYSGIRTNGATSACRRSESSFYAEMKWLLSNTDNAAFPPMTKSYKNTRKAPALIIWGIHHSGSTAEQTKLYGSGNKLVTVRSSNYQQSFVPSPGAGPKVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCLILLAIAMGLVFICVKNGNMRCTICI

SEQ ID NO: 10227 - protein, 560 aa, Artificial Sequence
  hemagglutinin__InfluenzaA__AGQ81012
MNTQILVFALIAIIPTNSDKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGINKEAMGFTYSGIRTNGATSACRRSGSSFYAEMKWLLSNTDNAAFPPMTKSYKNTRKAPALIIWGIHHSGSTAEQTKLYGSGNKLVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10228 - protein, 560 aa, Artificial Sequence
  hemagglutinin__InfluenzaA__AGQ81017
MNTQILVFALIAITPTNSDKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPPMTKSYKNTRKAPALIIWGIHHSGSTAEQTKLYGSGNKLVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10229 - protein, 560 aa, Artificial Sequence
  hemagglutinin__InfluenzaA__AGQ81018
MNTQILVFALIAIIPTNSDKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGIVKEAMGFTYSGIRTNGATSACRRSGSSFYAEMKWLLSNTDNAAFPPMTKSYKNTRKAPAIIIWGIHHSGSTAEQTKLYGSGNKLVTVRSSNYQQSFVPSPGAGPQVNGQSGRIDFHWLMLNPNDTVTFSFNGAFIAPDRASFLRGKSMGIQSGVQVDANCEGDCYHSRGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10230 - protein, 560 aa, Artificial Sequence; identical to SEQ ID NO: 10229
  hemagglutinin__InfluenzaA__AGQ81019

SEQ ID NO: 10231 - protein, 560 aa, Artificial Sequence; identical to SEQ ID NO: 10228
  hemagglutinin__InfluenzaA__AGQ81020

SEQ ID NO: 10232 - protein, 560 aa, Artificial Sequence; identical to SEQ ID NO: 10229
  hemagglutinin__InfluenzaA__AGQ81021

SEQ ID NO: 10233 - protein, 560 aa, Artificial Sequence; identical to SEQ ID NO: 10228
  hemagglutinin__InfluenzaA__AGQ81022

SEQ ID NO: 10234 - protein, 560 aa, Artificial Sequence; identical to SEQ ID NO: 10229
  hemagglutinin__InfluenzaA__AGQ81023

SEQ ID NO: 10235 - protein, 560 aa, Artificial Sequence
  hemagglutinin__InfluenzaA__AGQ81025
MNTQILVFALIAIIPTNADKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGIDKEAMGFTYSGIRTNGVTSACRRSGSSFYAEMKWLLSNTDNAAFPPMTKSYKNTRKAPALIIWGIHHSGSTAEQTKLYGSGNKLVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFGLIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVVICVKNGNMRCTICI

SEQ ID NO: 10236 - protein, 560 aa, Artificial Sequence
  hemagglutinin__InfluenzaA__AGQ81026
MNTQILVFALIAIIPTNADKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPPTTKSYKNTRKAPALIIWGIHHSGSTAEQTKLYGSGNKLVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10237 - protein, 560 aa, Artificial Sequence
  hemagglutinin__InfluenzaA__AGQ81027
MNTQILVFALIAIIPTNADKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGIDKEAMGFTYSGIRTNGVTSACRRSGSSFYAEMKWLLSNTDNAAFPPMTKSYKNTRKAPALIIWGIHHSGSTAEQTKLYGSGNKLVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10238 - protein, 560 aa, Artificial Sequence
  hemagglutinin__InfluenzaA__AGQ81028
MNTQILVFALIAIIPTNADKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPPTTKSYKNTRKAPALIIWGIHHSGSTAEQTKLYGSGNKLVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEMWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10239 - protein, 560 aa, Artificial Sequence
  hemagglutinin__InfluenzaA__AGQ81029
MNTQILVFALIAIIPTNADKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGIDKEAMGFTYSGIRTNGVTSACRRSGSSFYAEMKWLLSNTDNAAFPPMTKSYKNTRKAPALIIWGIHHSGSTAEQTKLYGSGNKLVTVRSSNYQQSFMPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10240 - protein, 560 aa, Artificial Sequence
  hemagglutinin__InfluenzaA__AGQ81031
MNTQILVFALIAIIPTNADKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGINKEAMGFTYSGIRTNGATSACRRSGSSFYAEMKWLLSNTDNAAFPPMTKSYKNTRKAPALIIWGIHHSGSTAEQTKLYGSGNKMVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVERQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10241 - protein, 560 aa, Artificial Sequence; identical to SEQ ID NO: 10236
  hemagglutinin__InfluenzaA__AGQ81032

SEQ ID NO: 10242 - protein, 560 aa, Artificial Sequence; identical to SEQ ID NO: 10237
  hemagglutinin__InfluenzaA__AGQ81033

SEQ ID NO: 10243 - protein, 560 aa, Artificial Sequence; identical to SEQ ID NO: 10236
  hemagglutinin__InfluenzaA__AGQ81034

SEQ ID NO: 10244 - protein, 560 aa, Artificial Sequence; identical to SEQ ID NO: 10237
  hemagglutinin__InfluenzaA__AGQ81035

SEQ ID NO: 10245 - protein, 560 aa, Artificial Sequence; identical to SEQ ID NO: 10237
  hemagglutinin__InfluenzaA__AGQ81036

SEQ ID NO: 10246 - protein, 560 aa, Artificial Sequence; identical to SEQ ID NO: 10237
  hemagglutinin__InfluenzaA__AGQ81037

SEQ ID NO: 10247 - protein, 560 aa, Artificial Sequence; identical to SEQ ID NO: 10229
  hemagglutinin__InfluenzaA__AGQ81038

SEQ ID NO: 10248 - protein, 560 aa, Artificial Sequence; identical to SEQ ID NO: 10229
  hemagglutinin__InfluenzaA__AGQ81039

SEQ ID NO: 10249 - protein, 560 aa, Artificial Sequence
  hemagglutinin__InfluenzaA__AGQ81040
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKDPALIIWGIHHSGSTAEQTKLYGSGNKLVTVGSSNYQQSFVPSPGARPQVNGQSGRIDFHWLMLNPNDTVTFSFNGAFIAPDRASFLRGKSMGIQSGVQIDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10250 - protein, 560 aa, Artificial Sequence
  hemagglutinin__InfluenzaA__AGQ81041
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQTTKSYKNTRKDPALIIWGIHHSGSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10251 - protein, 560 aa, Artificial Sequence
  hemagglutinin__InfluenzaA__AGQ81042
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKDPALIIWGIHHSGSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10252 - protein, 560 aa, Artificial Sequence
  hemagglutinin__InfluenzaA__AGQ81043
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEEMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 10253 - protein, 560 aa, Artificial Sequence; identical to SEQ ID NO: 9988
  hemagglutinin__InfluenzaA__AGQ81044

SEQ ID NO: 10254 - protein, 560 aa, Artificial Sequence; identical to SEQ ID NO: 9988
  hemagglutinin__InfluenzaA__AGQ81045

SEQ ID NO: 10255 - protein, 560 aa, Artificial Sequence; identical to SEQ ID NO: 9988
  hemagglutinin__InfluenzaA__AGQ81046

SEQ ID NO: 10256 - protein, 560 aa, Artificial Sequence; identical to SEQ ID NO: 10237
  hemagglutinin__InfluenzaA__AGQ81047

SEQ ID NO: 10257 - protein, 560 aa, Artificial Sequence; identical to SEQ ID NO: 10236
  hemagglutinin__InfluenzaA__AGQ81049

SEQ ID NO: 10258 - protein, 560 aa, Artificial Sequence; identical to SEQ ID NO: 10237
  hemagglutinin__InfluenzaA__AGQ81050

SEQ ID NO: 10259 - protein, 560 aa, Artificial Sequence
  hemagglutinin__InfluenzaA__AGQ81051
MNTQILVFALIAIIPTNADKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGINKEAMGFTYSGIRTNGATSACRRSGSSFYAEMKWLLSNTDNAAFPPMTKSYKNTRKAPALIIWGIHHSGSTAEQTKLYGSGNKLVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10260 - protein, 560 aa, Artificial Sequence; identical to SEQ ID NO: 10237
  hemagglutinin__InfluenzaA__AGQ81052

SEQ ID NO: 10261 - protein, 560 aa, Artificial Sequence
  hemagglutinin__InfluenzaA__AGQ81053
MNTQILVFALIAIIPTNADKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGINKEAMGFTYSGIRTNGATSACRRSGSSFYAEMKWLLSNTDNAAFPPMTKSYKNTRKAPALIIWGIHHSGSTAEQTKLYGSGNKMVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYRKEAMQNRIQIDPVKLSSGYKDVILWFSFGASCFILLAIAMGLVFICVKNGNMRCTICI

SEQ ID NO: 10262 - protein, 560 aa, Artificial Sequence; identical to SEQ ID NO: 10237
  hemagglutinin__InfluenzaA__AGQ81055

SEQ ID NO: 10263 - protein, 560 aa, Artificial Sequence; identical to SEQ ID NO: 10237
  hemagglutinin__InfluenzaA__AGQ81056

SEQ ID NO: 10264 - protein, 560 aa, Artificial Sequence; identical to SEQ ID NO: 10237
  hemagglutinin__InfluenzaA__AGQ81057

SEQ ID NO: 10265 - protein, 560 aa, Artificial Sequence; identical to SEQ ID NO: 10237
  hemagglutinin__InfluenzaA__AGQ81058

SEQ ID NO: 10266 - protein, 560 aa, Artificial Sequence; identical to SEQ ID NO: 9988
  hemagglutinin__InfluenzaA__AGQ81059

SEQ ID NO: 10267 - protein, 560 aa, Artificial Sequence; identical to SEQ ID NO: 9988
  hemagglutinin__InfluenzaA__AGQ81060

SEQ ID NO: 10268 - protein, 560 aa, Artificial Sequence; identical to SEQ ID NO: 9988
  hemagglutinin__InfluenzaA__AGQ81061

SEQ ID NO: 10269 - protein, 560 aa, Artificial Sequence
  hemagglutinin__InfluenzaA__AGQ81081
MEVVSLITILLVITGSNADKICIGYQSTNSTETVDTLTENNVPVTHAKELLHTEHNGMLCATNLGRPLILDTCTIEGLIYGNPSCDILLGGREWSYIVERPSAVNGLCYPGNVENLEELRSLFSSASSYQRIQIFPDTIWNVSYSGTSKACSDSFYRSMRWLTQKNNAYPVQDAQYTNNRGRNILFMWGINHPPTDTAQTNLYTRTDTTTSVATEDINRTFKPLIGPRPLVNGLQGRIDYYWAVLRPGQTLRIRSNGNLIAPWYGHILSGESHGRILKTDLNSGNCVVQCQTERGGLNTTLPFHNVSKYAFGNCPKYVGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINNKIDDQIQDIWAYNAELLVLLENQKTLDEHDANVNNLYNKVKRALGSNAVEDGKGCFELYHKCDNQCMETIRNGTYNRRKYKEESRLERQKIEGVKLESEGTYKILTIYSTVASSLVIAMGFAAFLFWAMSNGSCRCNICI

SEQ ID NO: 10270 - protein, 560 aa, Artificial Sequence
  hemagglutinin__InfluenzaA__AGQ81086
MEVVSLITILLVITGSNADKICIGYQSTNSTETVDTLTENNVPVTHAKELLHTEHNGMLCATNLGRPLILDTCTIEGLIYGNPSCDLLLGGREWSYIVERPSAVNGLCYPGNVENLEELRSLFSSASSYQRIQIFPDTIWNVSYSGTSKACSDSFYRSMRWLTQKNNAYPVQDAQYTNNRGRNILFMWGINHPPTDTAQTNLYTRTDTTTSVATEDINRTFKPLIGPRPLVNGLQGRIDYYWAVLRPGQTLRIRSNGNLIAPWYGHILSGESHGRILKTDLNSGNCVVQCQTERGGLNTTLPFHNVSKYAFGNCPKYVGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINNKIDDQIQDIWAYNAELLVLLENQKTLDEHDANVNNLYNKVKRALGSNAVEDGKGCFELYHKCDNQCMETIRNGTYNRRKYKEESRLERQKIEGVKLESEGTYKILTIYSTVASSLVIAMGFAAFLFWAMSNGSCRCNICI

SEQ ID NO: 10271 - protein, 560 aa, Artificial Sequence
  hemagglutinin__InfluenzaA__AGQ81087
METVSLITMLLVATVINADKICIGYQSTNSTETVDTLTENNVPVTHAKELLHTEHNGMLCATNLGHPLILDTCTIEGLIYGNPSCDLLLGGREWSYIVERPSAVNGLCYPGNVENLEELRSLFSSASSYQRIQIFPDTIWNVSYSGTSKACSDSFYRSMRWLTQKNNAYPIQDAQYTNNREKNILFMWGINHPPTDTAQTNLYTRTDTTTSVATEEINRTFKPLIGPRPLVNGLQGRIDYYWSVLKPGQTLRIRSNGNLIAPWYGHILSGESHGRVLKTDLKRGSCTVQCQTEKGGLNTTLPFQNVSKYAFGNCSKYVGVKSLKLAVGLRNVPSRSSRGLFGAIAGFIEGGWSGLVAGWYGFQHSNDQGVGMAADRDSTQKAIDKMTSKVNNIVDKMNKQYEIINHEFSEIETRLNMINNKIDDQIQDIWAYNAELLVLLENQKTLDEHDANVNNLYNKVKRALGSNAVEDGKGCFELYHKCDDQCMETIRNGTYNRRRYQEESKLERQKIEGVKLESEGTYKILTIYSTVASSLVIAMGFAAFLFWAMSNGSCRCNICI

SEQ ID NO: 10272 - protein, 560 aa, Artificial Sequence
  hemagglutinin__InfluenzaA__AGQ81092
MEVVSLITILLVITGSNADKICIGYQSTNSTETVDTLTENNVPVTHAKELLHTEHNGMLCATNLGRPLILDTCTIEGLIYGNPSCDLLLGGREWSYIVERPSAVNGLCYPGNVENLEELRSLFSSASSYQRIQIFPDTIWNVSYTGTSKACSDSFYRSMRWLTQKNNAYPVQDAQYTNNRGRNILFMWGINHPPTDTTQTNLYTRTDTTTSVATEDINRTFKPLIGPRPLVNGLQGRIDYYWAVLRPGQTLRIRSNGNLIAPWYGHILSGESHGRILKTDLKSGNCVVQCQTERGGLNTTLPFHNVSKYAFGNCPKYVGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINNKIDDQIQDIWAYNAELLVLLENQKTLDEHDANVNNLYNKVKRALGSNAVEDGKGCFELYHKCDNQCMETIRNGTYNRRKYKEESRLERQKIEGVKLESEGTYKILTIYSTVASSLVIAMGFAAFLFWAMSNGSCRCNICI

SEQ ID NO: 10273 - protein, 560 aa, Artificial Sequence
  hemagglutinin__InfluenzaA__AGQ81095
MEVVSLITILLVITVSNADKICIGYQSTNSTETVNTLTEDNVPVTHAKELLHTEHNGMLCATNLGRPLILDTCTIEGLIYGNPSCDLLLGGREWSYIVERPSAVNGLCYPGNVENLEELRSLFSSASSYQRIQIFPDTIWNVSYSGTSKACSDSFYRSMRWLTQKNNAYPVQDAQYTNNRGRNILFMWGINHPPTDTAQTNLYTRTDTTTSVATEDINRTFKPLIGPRPLVNGLQGRIDYYWAVLKPGQTLRIRSNGNLIAPWYGHILSGESHGRILKTDLNSGNCVVQCQSERGGLNTTLPFHNVSKYAFGNCPKYVGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINNKIDDQIQDIWAYNAELLVLLENQKTLDEHDANVNNLYNKVKRALGSNAVEDGKGCFELYHKCDNQCMETIRNGTYDRRKYKEESRLERQKIEGVKLESEGTYKILTIYSTVASSLVIAMGFAAFLFWAMSNGSCRRNICI

SEQ ID NO: 10274 - protein, 560 aa, Artificial Sequence
  hemagglutinin__InfluenzaA__AGQ81099
METVSLITILLIVTVSNADKICIGYQSTNSTETVDTLTENNVPVTHAKELLHTEHNGMLCATNLGHPLILDTCTIEGLIYGNPSCDLLLGGREWSYIVERPSAVNGLCYPGNVENLEELRSLFSSANSYQRIQIFPDTIWNVSYSGTSKACSDSFYRSMRWLTQKNNAYPTQDAQYTNNREKNILFMWGINHPPTDTAQTNLYTRTDTTTSVATEEINRTFKPLIGPRPLVNGLQGRIDYYWSVLKPGQTLRIRSNGNLIAPWYGHILSGESHGRILKTDLKRGSCTVQCQTEKGGLNTTLPFQNVSKYAFGNCSKYVGVKSLKLAVGLRNVPSRSSRGLFGAIAGFIEGGWSGLVAGWYGFQHSNDQGVGMAADRDSTQKAIDKVTSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRRNICI

SEQ ID NO: 10275 - protein, 560 aa, Artificial Sequence
  hemagglutinin__InfluenzaA__AGQ81100
METVSLITMLLVATVINADKICIGYQSTNSTETVDTLTENNVPVTHAKELLHTEHNGMLCATNLGHPLILDTCTIEGLIYGNPSCDLLLGGREWSYIVERPSAVNGLCYPGNVENLEELRSLFSSASSYQRIQIFPDTIWNVSYSGTSKACSDSFYRSMRWLTQKNNAYPIQDAQYTNNREKNILFMWGINHPPTDTAQTNLYTRTDTTTSVATEEINRTFKPLIGPRPLVNGLQGRIDYYWSVLKPGQTLRIRSNGNLIAPWYGHILSGESHGRILKTDLKRGSCTVQCQTEKGGLNTTLPFQNVSKYAFGNCSKYVGVKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRRYQEESKLERQKIEGVKLESEGTYKILTIYSTVASSLVIAMGFAAFLFWAMSNGSCRRNICI

SEQ ID NO: 10276 - protein, 560 aa, Artificial Sequence
  hemagglutinin__InfluenzaA__AGQ81123
MEVVSLITILLVITVSNADKICIGYQSTNSTETVNTLTEDNVPVTHAKELLHTEHNGMLCATNLGRPLILDTCTIEGLIYGNPSCDLLLGGREWSYIVERPSAVNGLCYPGNVENLEELRSLFSSASSYQRIQIFPDTIWNVSYSGTSKACSDSFYRSMRWLTQKNNAYPVQDAQYTNNKGRNILFMWGINHPPTDTAQTNLYTRTDTTTSVATEDINRTFKPLIGPRPLVNGLQGRIDYYWAVLKPGQTLRIRSNGNLIAPWYGHILLGESHGRILKTDLNSGDCVVQCQSERGGLNTTLPFHNVSKYAFGNCPKYVGVKSLKLAVGLRNVPARSTRGLFGAIAGFIEGGWSGLVAGWYGFQHSNDQGTGMAADRDSTQKAIDKITSKVNNIVDKMNKQYEIIDHEFSEIETRLNMINNKIDDQIQDIWAYNAELLVLLENQKTLDEHDANVNNLYNKVKRALGSNAVEDGKGCFELYHKCDNQCMETIRNGTYDRRKYKEESRLERQKIEGVKLESEGTYKILTIYSTVASSLVIAMGFAAFLFWAMSNGSCRCNICI

SEQ ID NO: 10277 - protein, 560 aa, Artificial Sequence
  hemagglutinin__InfluenzaA__AGQ81124
MEVATLITILLVITGSNADKICIGYQSTNSTETVDTLTENNVPVTHAKELLHTEHNGMLCATNLGRPLILDTCTIEGLIYGNPSCDLPLEGREWSYIVERPSAVNGVCYPGNVENLEELRSLFSSASSYQRIQIFPDSIWNVSYSGTSKACSDSFYRNMRWLTQKDNNYPVQDAQYTNNRGKNILFMWGINHPPTDTAQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQKESRLERQKIEGVKLESEGTYKILTIYSTVASSLVIAMGFAAFLFWAMSNGSCRCNICI

SEQ ID NO: 10278 - protein, 560 aa, Artificial Sequence
  hemagglutinin__InfluenzaA__AGQ81125
MEVATLITILLVITGSNADKICIGYQSTNSTETVDTLTENNVPVTHAKELLHTEHNGMLCATNLGRPLILDTCTIEGLIYGNPSCDLPLEGREWSYIVERPSAVNGVCYPGNVENLEELRSLFSSASSYQRIQIFPDSIWNVSYSGTSKACSDSFYRSMRWLTQKDNNYPVQDAQYTNNRGKNILFMWGINHPPTDTAQTNLYTRTDTTTSVATEDINRTFKPLIGPRPLVNGLQGRIDYYWAVLKPGQTLRVRSNGNLIAPWYGHILLGVSHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10279 - protein, 560 aa, Artificial Sequence
  hemagglutinin__InfluenzaA__AGQ81126
METISLMTILLITTASNADKICIGHQSTNSTETVDTLTETNVPVTHAKELLQTEHNGMLCATNLGHPLILDTCTIEGLIYGNPSCDLLLEGREWSYIVERPSAVNGTCYPGNVENLEELRTLFSSASSYQRIQIFPDTIWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKGGNCVVQCQTEKGGFNSTLPFHNISKYAFGTCPKYVKVNSLKLAIGLRNVPARSNRGLFGAIAGFIEGGWPGLVAGWYGFQHSNDQGVGMAADRDSTQKAVDKITSKVNNIVDKMNKQYEIIDHEFSEVETRLNMINNKIDDQIQDIWAYNAELLVLLENQKTLDEHDANVNNLYNKVKRALGSNAMEDGKGCFELYHKCDDQCMETIRNGTYNRRKYREESRLEQQRIEGVKLESEGTYKILTIYSTVASSLVLAMGFAAFLFWAMSNGSCRCNICI

SEQ ID NO: 10280 - protein, 560 aa, Artificial Sequence
  hemagglutinin__InfluenzaA__AGQ81127
MEVATLITILLLITGSNADKICIGYQSTNSTETVDTLTENNVPVTHAKELLHTEHNGMLCATNLGRPLILDTCTIEGLIYGNPSCDLPLEGREWSYIVERPSAVNGVCYPGNVENLEELRSLFSSASSYQRIQIFPDSIWNVSYSGTSKACSDSFYRSMRWLTQKNNNYPVQDAQYTNNRGKNILFMWGINHPPTDTAQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10281 - protein, 560 aa, Artificial Sequence
  hemagglutinin__InfluenzaA__AGQ81128
MEAATIITILLVITGSNADKICIGYQSTNSTETVDTLTENNVPVTHAKELLHTEHNGMLCATNLGRPLILDTCTIEGLIYGNPSCDLPLEGREWSYIVERPSAVNGVCYPGNVENLEELRSLFSSASSYQRIQIFPDSIWNVSYSGTSKACSDSFYRSMRWLTQKNNNYPVQDAQYTNNRGKNILFMWGINHPPTDTAQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYDIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVVAMGFAAFLFWAMSNGSCRCNICI

SEQ ID NO: 10282 - protein, 560 aa, Artificial Sequence
  hemagglutinin__InfluenzaA__AGQ81130
METVSLITILLVVTIGNADKICIGYQSTNSTETVDTLTENNVPVTHAKELLHTEHNGMLCATSLGHPLILDTCTIEGLIYGNPSCDLLLGGREWSYIVERPSAVNGLCYPGNVENLEELRSLFSSARSYQRIQIFPDTIWNVSYSGTSKACSDSFYRSMRWLTQKNNAYPIQDAQYTNNQEKNILFMWGINHPPTDTVQTNLYTRTDTTTSVATEEINRTFKPLIGPRPLVNGLQGRIDYYWSVLKPGQTLRIRSNGNLIAPWYGHILSGESHGRILKTDLKRGSCTVQCQTEKGGLNTTLPFQNVSKYAFGNCSKYIGMKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGFNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 10283 - protein, 560 aa, Artificial Sequence
  hemagglutinin__InfluenzaA__AGQ81132
METISLMTILLITTASNADKICIGHQSTNSTETVDTLTETNVPVTHAKELLQTEHNGMLCATNLGHPLILDTCTIEGLIYGNPSCDLLLEGREWSYIVERPSAVNGTCYPGNVENLEELRTLFSSASSYQRIQIFPDTIWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKGGNCVVQCQTEKGGFNSTLPFHNISKYAFGTCPKYVKVNSLKLAIGLRNVPARSNRGLFGAIAGFIEGGWPGLVAGWYGFQHSNDQGVGMAADRDSTQKAVDKITSKVNNIVDKMNRQYEIIDHEFSEVETRLNMINNKIDDQIQDIWAYNAELLVLLENQKTLDEHDANVNNLYNKVKRALGSNAMEDGKGCFELYHKCDDQCMETIRNGTYNRRKYREESRLEQQRIEGVKLESEGTYKILTIYSTVASSLVLAMGFAAFLFWAMSNGSCRCNICI

SEQ ID NO: 10284 - protein, 560 aa, Artificial Sequence
  hemagglutinin__InfluenzaA__AGQ81133
METISLMTILLITTASNADKICIGHQSTNSTETVDTLTETNVPVTHAKELLQTEHNGMLCATNLGHPLILDTCTIEGLIYGNPSCDLLLEGREWSYIVERPSAVNGTCYPGNVENLEELRTLFSSASSYQRIQIFPDTIWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHILSGGSHGRILKTDLKSGNCVVQCQTEKGGFNSTLPFHNISKYAFGTCPKYVKVNSLKLAIGLRNVPARSNRGLFGAIAGFIEGGWPGLVAGWYGFQHSNDQGVGMAADRDSTQKAVDKITSKVNNIVDKMNKQYEIIDHEFSEVETRLNMINNKIDDQIQDIWAYNAELLVLLENQKTLDEHDANVNNLYNKVKRALGSNAMEDGKGCFELYHKCDDQCMETIRNGTYNRRKYREESRLEQQRIEGVKLESEGTYKILTIYSTVASSLVLAMGFAAFLFWAMSNGSCRCNICI

SEQ ID NO: 10285 - protein, 560 aa, Artificial Sequence
  hemagglutinin__InfluenzaA__AGQ81134
METISLMTILLITTASNADKICIGHQSTNSTETVDTLTETNVPVTHAKELLQTEHNGMLCATNLGHPLILDTCTIEGLIYGNPSCDLLLEGREWSYIVERPSAANGTCYPGNVENPEELRTLFSSASSYQRIQIFPDTIWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKSGNCVVQCQTEKGGFNSTLPFHNISKYAFGTCPKYVKVNSLKLAIGLRNVPARSNRGLFGAIAGFIEGGWPGLVAGWYGFQHSNDQGVGMAADRDSTQKAVDKITSKVNNIVDKMNKQYEIIDHEFSEVETRLNMINNKIDDQIQDIWAYNAELLVLLENQKTLDEHDANVNNLYNKVKRALGSNAMEDGKGCFELYHKCDDQCMETIRNGTYNRRKYREESRLEQQRIEGVKLESEGTYKILTIYSTVASSLVLAMGFAAFLFWAMSNGSCRCNICI

SEQ ID NO: 10286 - protein, 560 aa, Artificial Sequence
  hemagglutinin__InfluenzaA__AGQ81135
MEVATIITILLVITGSNADKICIGYQSTNSTETVDTLTENNVPVTHAKELLHTEHNGMLCATNLGRPLILDTCTIEGLIYGNPSCDLPLEGREWSYIVERPSAVNGVCYPGNVENLEELRSLFSSASSYQRIQIFPDSIWNVSYSGTSKACSDSFYRSMRWLTQKNNNYPVQDAQYTNNRGKNILFMWGINHPPTDNAQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYSFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFNEIETRLNMINNKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10287 - protein, 560 aa, Artificial Sequence
  hemagglutinin__InfluenzaA__AGQ81136
METISLMTILLITTASNADKICIGHQSTNSTETVDTLTETNVPVTHAKELLQTEHNGMLCATNLGHPLILDTCTIEGLIYGNPSCDLLLEGREWSYIVERPSAVNGTCYPGNVENLEELRTLFSSASSYQRIQIFPDTIWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKGGNCVVQCQTEKGGFNSTLPFHNISKYAFGTCPKYVKVNSLKLAIGLRNVPARSNRGLFGAIAGFIEGGWPGLVAGWYGFQHSNDQGVGMAADRDSTQKAVDKITSKVNNIVDKMNRQYEIIDHEFSEVETRLNMINNKIDDQIQDIWTYNAELLVLLENQKTLDEHDANVNNLYNKVKRALGSNAMEDGKGCFELYHKCDDQCMETIRNGTYNRRKYREESRLEQQRIEGVKLESEGTYKILTIYSTVASSLVLAMGFAAFLFWAMSNGSCRCNICI

SEQ ID NO: 10288 - protein, 560 aa, Artificial Sequence; identical to SEQ ID NO: 10283
  hemagglutinin__InfluenzaA__AGQ81137

SEQ ID NO: 10289 - protein, 560 aa, Artificial Sequence
  hemagglutinin__InfluenzaA__AGQ81138
MEAATIITILLAITGSNADKICIGYQSTNSTETVDTLTENNVPVTHAKELLHTEHNGMLCATNLGRPLILDTCTIEGLIYGNPSCDLPLEGREWSYIVERPSAVNGVCYPGHVENLEELRSLFSSASSYQRVQIFPDSIWNVSYSGTSKACSDSFYRSMRWLTQKNNNYPVQDAQYTNNKGKNILFMWGINHPPTDTAQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVHARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10290 - protein, 560 aa, Artificial Sequence
  hemagglutinin__InfluenzaA__AGQ81139
MEVATIITILLVITGGNADKICIGYQSTNSTETVDTLTENNVPVTHAKELLHTEHNGMLCATNLGRPLILDTCTIEGLIYGNPSCDLPLEGREWSYIVERSSAVNGVCYPGNVENLEELRSLFSSASSYQRIQIFPDSIWNVSYSGTSKACSDSFYRSMRWLTQKNNNYPVQDAQYTNNRGKNILFMWGINHPPTDNAQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYSFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINNKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10291 - protein, 560 aa, Artificial Sequence
  hemagglutinin__InfluenzaA__AGQ81141
MEAATIITILLVITGSNADKICIGYQSTNSTETVDTLTENNVPVTHAKELLHTEHNGMLCATDLGRPLILDTCTIEGLIYGNPSCDLPLEGREWSYIVERPSAVNGVCYPGNVENLEELRSLFSSASSYQRIQIFPDSIWNVSYSGTSKACSDSFYRSMRWLTQKNNNYPVQDAQYTNNRGKNILFMWGINHPPTDTAQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSRRGLFGAIAGFIEGGWTGLVAGWYGFQHSNDQGTGMAADRDSTQKAIDKITSKVNNIVDKMNKQYDIIDHEFSEIETRLNMINDKIDDQIQDIWAYNAELLVLLENQKTLDEHDANVNNLYNKVKGALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10292 - protein, 560 aa, Artificial Sequence
  hemagglutinin__InfluenzaA__AGQ81143
MEVATIITILLVITGSNADKICIGYQSTNSTETVDTLTENNVPVTHAKELLHTEHNGMLCATNLGRPLILDTCTIEGLIYGNPSCDLPLEGREWSYIVERPSAVNGVCYPGNVENLEELRSLFSSASSYQRIQIFPDSIWNVSYSGTSKACSDSFYRSMRWLTQKNNNYPVQDAQYTNNRGKNILFMWGINHPPTDNAQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYSFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINNKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10293 - protein, 560 aa, Artificial Sequence
  hemagglutinin__InfluenzaA__AGQ81144
MEAATIITILLVVTGSNADKICIGYQSTNSTETVDTLTENNVPVTHAKELLHTEHNGMLCATNLGRPLILDTCTIEGLIYGNPSCDLPLEGREWSYIVERPSAVNGVCYPGNVENLEELRSLFSSASSYQRIQIFPDSIWNVSYGGTSKACSDSFYRSMRWLTQKNNNYPVQDAQYTNNRGKNILFMWGINHPPTDTAQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNMPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10294 - protein, 560 aa, Artificial Sequence
  hemagglutinin__InfluenzaA__AGQ81146
MEAATIITILLVITGSNADKICIGYQSTNSTETVDTLTENNVPVTHAKELLHTEHNGMLCATNLGRPLILDTCTIEGLIYGNPSCDLPLEGKEWSYIVERPSAVNGMCYPGNVENLEELRSLFSSASSYQRIQIFPDSIWNVSYSGTSKACSDSFYRSMRWLTQKNNNYPVQDAQYTNNRGKNILFMWGINHPPTDTAQTNLYTRTDTKTSVATEEINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDSNVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10295 - protein, 560 aa, Artificial Sequence
  hemagglutinin__InfluenzaA__AGQ81147
MEAATIITILLVITGSNADKICIGYQSTNSTETVDTLTENNVPVTHAKELLHTEHNGMLCATNLGRPLILDTCTIEGLIYGNPSCDLPLEGKEWSYIVERPSAVNGMCYPGNVENLEELRSLFSSASSYQRIQIFPDSIWNVSYSGTSKACSDSFYRSMRWLTQKNNNYPVQDAQYTNNRGKNILFMWGINHPPTDTVQTNLYTRTDTKTSVATEEINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10296 - protein, 560 aa, Artificial Sequence
  hemagglutinin__InfluenzaA__AGQ81148
MEAATIITILLVITGSNADKICIGYQSTNSTETVDTLTENNVPVTHAKELLHTEHNGMLCATNLGRPLILDTCTIEGLIYGNPSCDLPLEGKEWSYIVERPSAVNGMCYPGNVENLEELRSLFSSASSYQRIQIFPDSIWNVSYSGTSKACSDSFYRSMRWLTQKNNNYPVQDAQYTNNRGKNILFMWGINHPPTDTAQTNLYTRTDTKTSVATEEINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10297 - protein, 560 aa, Artificial Sequence
  hemagglutinin__InfluenzaA__AGQ81149
MEAATIITILLVITGSNADKICIGYQSTNSTETVDTLTENNVPVTHAKELLHTGHNGMLCATNLGRPLILDTCTIEGLIYGNPSCDLPLEGREWSYIVERPSAINGVCYPGNVENLEELRSLFSSASSYQRIQIFPDSIWNVSYSGTSKACSDSFYRSMRWLTQKNNNYPVQDAQYTNNRGKNILFMWGINHPPTDTAQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10298 - protein, 560 aa, Artificial Sequence
  hemagglutinin__InfluenzaA__AGQ81150
MEAATIITILLVITGSNADKICIGYQSTNSTETVDTLTENNVPVTHAKELLHTEHNGMLCATDLGRPLILDTCTIEGLIYGNPSCDLPLEGREWSYIVERPSAVNGVCYPGNVENLEELRSLFSSASSYQRIQIFPDSIWNVSYSGTSKACSDSFYRSMRWLTQKNNNYPVQDAQYTNDRGNNILFMWGINHPPTDTVQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYDIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10299 - protein, 560 aa, Artificial Sequence
  hemagglutinin__InfluenzaA__AGQ81152
MEAATIITILLVITGSNADKICIGYQSTNSTETVDTLTENNVPVTHAKELLHTEHNGMLCATNLGRPLILDTCTIEGLIYGNPSCDLPLEGRDWSYIVERPSAVNGVCYPGNVENLEELRSLFSSASSYQKIQIFPDSIWNVSYSGTSKACSDSFYRSMRWLTQKNNNYPVQDAQYTNNRGKNILFMWGINHPPTDTVQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10300 - protein, 560 aa, Artificial Sequence
  hemagglutinin__InfluenzaA__AGQ81153
MEAATIITILLVITGSNADKICIGYQSTNSTETVDTLTENNVPVTHAKELLHTEHNGMLCATNLGRPLILDTCTIEGLIYGNPSCDLPLEGRDWSYIVERPSAVNGVCYPGNVENLEELRSLFSSASSYQKIQIFPDSIWNVSYGGISKACSNSFYRSMRWLTQKNNNYPVQDAQYTNNRGKNILFMWGINHPPTNTTQTDLYTRTDTTTSVATEDIHRTFKPLIGPRPLVNGLQGRIDYYWAVLKPGQTLRVRSNGNLIAPWYGHILLGKSHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10301 - protein, 560 aa, Artificial Sequence
  hemagglutinin__InfluenzaA__AGQ81155
MEAATIITILLVITGSNADKICIGYQSTNSTETVDTLTENNVPVTHAKELLHTEHNGMLCATNLGRPLILDTCTIEGLIYGNPSCDLPLEGRDWSYIVERPSAVNGVCYPGNVENLEELRSLFSSASSYQKIQIFPDSIWNVSYNGTSKACSDSFYRSMRWLTQKNNNYPVQDAQYTNNRGKNILFMWGINHPPTDTTQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGDCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQEIEGVKLESEGTYKILTIYSTVASSLVIAMGFAAFLFWAMSNGSCRCNICI

SEQ ID NO: 10302 - protein, 560 aa, Artificial Sequence
  hemagglutinin__InfluenzaA__AGQ81156
MEAATIITILLVITGSNADKICIGYQSTNSTETVDTLTENNVPVTHAKELLHTEHNGMLCATNLGRPLILDTCTIEGLIYGNPSCDLPLEGRDWSYIVERPSAVNGVCYPGNVENLEELRSLFSSASSYQKIQIFPDSIWNVSYGGISKACSNSFYRSMRWLTQKNNNYPVQDAQYTNNRGKNILFMWGINHPPTNTTQTDLYTRTDTTTSVATEDIHRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10303 - protein, 560 aa, Artificial Sequence
  hemagglutinin__InfluenzaA__AGQ81157
MEAATIITILLVITGNNADKICIGYQSTNSTETVDTLTENNVPVTHAKELLHTEHNGMLCATNLGRPLILDTCTIEGLIYGNPSCDLPLEGRDWSYIVERPSAVNGVCYPGNVENLEELRSLFSSASSYQKIQIFPDSIWNVSYNGTSKACSDSFYRSMRWLTQKNNNYPVQDAQYTNNRGKNILFMWGINHPPTDTTQTNLYTRTDTTTSVATEDINRTFKPLIGPRPLVNGLQGRIDYYWAVLKPGQTLRVRSNGNLIAPWYGHILLGESHGRILKTDLKSGNCVVQCQTERGGLNTTLPFHNVSKYAFGDCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10304 - protein, 560 aa, Artificial Sequence
  hemagglutinin__InfluenzaA__AGQ81158
MEVVTIITILLVITRSNADKICIGYQSTNSTETVDTLTENNVPVTHAKELLHTEHNGMLCATNLGRPLILDTCTIEGLIYGNPSCDLPLEGREWSYIVERPSAVNGVCYPGNVENLEELRSLFSSASSYQRIQIFPDSIWNVSYSGTSKACSDSFYRSMRWLTQKNNNYPVQDAQYTNNRGKNILFMWGINHPPTDTAQTNLYTRTDTTTSVATEDINRTFKPLIGPRPLVNGLQGRIDYYWAVLKPGQTLRVRSNGNLIAPWYGHILLGESHGRILKTDLKSGSCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIINHEFSEIETRLNMINDKIDDQIQDIWAYNAELLVLLENQKTLDEHDANVNNLYNKVKRALGSNAVEDGKGCFDLYHKCDNQCMETIRNGTYNRRMYQEESRLERQKIEGVKLESEGTYKILTIYSTVASSLVIAMGFAAFLFWAMSNGSCRCNICI

SEQ ID NO: 10305 - protein, 560 aa, Artificial Sequence
  hemagglutinin__InfluenzaA__AGQ81159
MEAATIITILLVITGSNADKICIGYQSTNSTETVDTLTENNVPVTHAKELLHTEHNGMLCATNLGRPLILDTCTIEGLIYGNPSCDLPLEGRDWSYIVERPSAVNGVCYPGNVENLEELRSLFSSASSYQKIQIFPDSIWNVSYDGISKACSNSFYRSMRWLTKKNNSYPVQDAQYTNNIGKNILFMWGINHPPTNTTQTDLYTRTDTTTSVATEDIHRTFKPLIGPRPPVNGLLGRIDYYWAVLKPGQTLRVRSNGNLIAPWYGHILLGESHGRILKTDLKSGNCVVQCQTERGGLNTTLPFHNVSKYAFGNCPKYIGVKSLKLAVGLRNVPARSSRGLFGAIAGFIEGGWSGLVAGWYGFQHSNDQGTGMAADRDSTQKAIDKITSKVNNIVDKMNKQYEIIDHEFSEIETRLNMINDKIDDQIQDIWAYNAELLVLLENQKTLDEHDANVNNLYNKVKRALGSNAVEDGKGCFDLYHKCDNQCMETIRNGTYNRRKYQEESRLERQKIEGVKLESEGTYKILTIYSTVASSLVIAMGFAAFLFWAMSNGSCRCNICI

SEQ ID NO: 10306 - protein, 560 aa, Artificial Sequence
  hemagglutinin__InfluenzaA__AGQ81161
METVSLITILLVATVSNADKICIGYQSTNSTETVDTLTENNVPVTHAKELLHTEHNGMLCATSLGQPLILDTCTIEGLIYGNPSCDPLLEGREWSYIVERPSAVNGLCYPGNVENLEELRSLFSSARSYQRIQIFPDTIWNVSYDGTSKACSGSFYRNMRWLTQKNSDYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKKGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 10307 - protein, 560 aa, Artificial Sequence
  hemagglutinin__InfluenzaA__AGQ81162
METVSLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTIWNVSYDGTSKACSGSFYRSMRWLTQKNSDYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKKGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRKKYQEESKLERQKIEGVKLESEGTYKILTIYSTVASSLVIAMGFAAFLFWAMSNGSCRCNICI

SEQ ID NO: 10308 - protein, 560 aa, Artificial Sequence
  hemagglutinin__InfluenzaA__AGQ81164
METVSLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTIWNVSYDGTSKACSGSFYRSMRWLTQKNSDYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKKGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 10309 - protein, 560 aa, Artificial Sequence
  hemagglutinin__InfluenzaA__AGQ81167
METVSLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTIWNVSYNGTSKACSGSFYRSMRWLTQKNSNYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKKGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 10310 - protein, 560 aa, Artificial Sequence
  hemagglutinin__InfluenzaA__AGQ81168
METVSLITILLVVTVSNADKICIGYQSTNSTETVDTLTENNVPVTHARELLHTEHNGMLCATSLGHPLILDTCTIEGLIYGNPSCDLLLGGREWSYIVERPSAVNGLCYPGNVENLEELRSLFSSARSYQRIQIFPDTIWNVSYSGTSKACSDSFYRSMRWLTQKGNAYPIQDAQYTNNQGKNILFMWGINHPPTDTAQTNLYTRTDTTTSVATEEINRTFKPLIGPRPLVNGLMGRINYYWSVLKPGQTLRIKSNGNLIAPWYGHILSGESHGRILKTDLKRGSCTVQCQTEKGGLNTTLPFQNVSKYAFGNCSKYIGMKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 10311 - protein, 560 aa, Artificial Sequence
  hemagglutinin__InfluenzaA__AGQ81169
METVSLITILLVVTVSNADKICIGYQSTNSTETVDTLTENNVPVTHARELLHTEHNGMLCATSLGHPLILDTCTIEGLIYGNPSCDLLLGGREWSYIVERPSAVNGLCYPGNVENLEELRSLFSSARSYQRIQIFPDTIWNVSYSGTSKACSDSFYRSMRWLTQKDNAYPIQDAQYTNNQEKNILFMWGINHPPTDTVQTNLYTRTDTTTSVATEEINRTFKPLIGPRPLVNGLMGRINYYWSVLKPGQTLRIKSNGNLIAPWYGHILSGESHGRILKTDLKRGSCTVQCQTEKGGLNTTLPFQNVSKYAFGNCSKYIGMKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 10312 - protein, 560 aa, Artificial Sequence
  hemagglutinin__InfluenzaA__AGQ81170
METVSLITILLVVTVSNADKICIGYQSTNSTETVDTLTENNVPVTHARELLHTEHNGMLCATSLGHPLILDTCTIEGLIYGNPSCDLLLGGREWSYIVERPSAVNGLCYPGNVENLEELRSLFSSARSYQRIQIFPDTIWNVSYSGTSKACSDSFYRSMRWLTQKDNAYPIQDAQYTNNQGKNILFMWGINHPPTDTAQTNLYTRTDTTTSVATEEINRTFKPLIGPRPLVNGLMGRINYYWSVLKPGQTLRIKSNGNLIAPWYGHILSGESHGRILKTDLKRGSCTVQCQTEKGGLNTTLPFQNVSKYAFGNCSKYIGMKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 10313 - protein, 560 aa, Artificial Sequence; identical to SEQ ID NO: 10312
  hemagglutinin__InfluenzaA__AGQ81171

SEQ ID NO: 10314 - protein, 560 aa, Artificial Sequence; identical to SEQ ID NO: 10312
  hemagglutinin__InfluenzaA__AGQ81172

SEQ ID NO: 10315 - protein, 560 aa, Artificial Sequence
  hemagglutinin__InfluenzaA__AGQ81173
METASLITILLVVTVSNADKICIGYQSTNSTETVDTLTENNVPVTHAKELLHTEHNGMLCATSLGNPLILDTCTIEGLIYGNPSCDLLLGGREWSYIVERPSAVNGLCYPGNVENLEELRSLFSSARSYQRIQIFPDTIWNVSYSGTSKACSDSFYRSMRWLTQKDNAYPIQDAQYTNNQGKNILFMWGINHPPTDTAQTNLYTRTDTTTSVATEEINRTFKPLIGPRPLVNGLMGRINYYWSVLKPGQTLRIKSNGNLIAPWYGHILSGESHGRILKTDLKRGSCTVQCQTEKGGLNTTLPFQNVSKYAFGNCSKYIGMKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 10316 - protein, 560 aa, Artificial Sequence; identical to SEQ ID NO: 10312
  hemagglutinin__InfluenzaA__AGQ81175

SEQ ID NO: 10317 - protein, 560 aa, Artificial Sequence
  hemagglutinin__InfluenzaA__AGQ81177
METVSLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTIWNVSYNGTSKACSGSFYRSMRWLTRKNGDYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 10318 - protein, 560 aa, Artificial Sequence; identical to SEQ ID NO: 10317
  hemagglutinin__InfluenzaA__AGQ81178

SEQ ID NO: 10319 - protein, 560 aa, Artificial Sequence; identical to SEQ ID NO: 10309
  hemagglutinin__InfluenzaA__AGQ81181

SEQ ID NO: 10320 - protein, 560 aa, Artificial Sequence; identical to SEQ ID NO: 10309
  hemagglutinin__InfluenzaA__AGQ81183

SEQ ID NO: 10321 - protein, 560 aa, Artificial Sequence; identical to SEQ ID NO: 10308
  hemagglutinin__InfluenzaA__AGQ81184

SEQ ID NO: 10322 - protein, 560 aa, Artificial Sequence
  hemagglutinin__InfluenzaA__AGQ81185
METASLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTTWNVSYNGTSKACSGSFYRSMRWLTQKNSNYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDNQCMETIRNGTYNRRKYQEESKLERQKIEGVKLESEGTYKILTIYSTVASSLVIAMGFAAFLFWAMSNGSCRCNICI

SEQ ID NO: 10323 - protein, 560 aa, Artificial Sequence
  hemagglutinin__InfluenzaA__AGQ81186
METVSLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTIWNVSYDGTSKACSGSFYRSMRWLTQKNSDYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKKGSCTVQCQTEKGGLNTTLPFQNVSKYAFGNCSKYIGIKSLKLAIGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRKKYQEESKLERQKIEGVKLESEGTYKILTIYSTVASSLVIAMGFAAFLFWAMSNGSCRCNICI

SEQ ID NO: 10324 - protein, 560 aa, Artificial Sequence; identical to SEQ ID NO: 10312
  hemagglutinin__InfluenzaA__AGQ81190

SEQ ID NO: 10325 - protein, 560 aa, Artificial Sequence; identical to SEQ ID NO: 10312
  hemagglutinin__InfluenzaA__AGQ81191

SEQ ID NO: 10326 - protein, 560 aa, Artificial Sequence; identical to SEQ ID NO: 10317
  hemagglutinin__InfluenzaA__AGQ81192

SEQ ID NO: 10327 - protein, 560 aa, Artificial Sequence
  hemagglutinin__InfluenzaA__AGQ81193
METVSLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTIWNVSYTGTSKACSGSFYRSMRWLTQKNGDYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHVLSGESHGRILKTDLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 10328 - protein, 560 aa, Artificial Sequence; identical to SEQ ID NO: 10312
  hemagglutinin__InfluenzaA__AGQ81194

SEQ ID NO: 10329 - protein, 561 aa, Artificial Sequence
  hemagglutinin__InfluenzaA__AGQ81195
MYKIVVIITLLGTVKGLDKICLGHHAVANGTIVKTLTNEQEEVTNATETVEGKSLNRLCMKGRNHKDLGNCHPIGMLIGTPACDLHLTGTWDTLIERENAIAYCYPGATINEEALRQKIMESGGISKISTGFTYGSSINSAGTTRACMRNGGNSFYAELKWLVSKSKGQNFPQTTNTYRNTDTSEHLIMWGIHHPSSTQEKNDLYGTQSLSISVGSSTYQNNFVPVVGARPQVNGQSGRIDFHWTLVQPGDNITFSHNGGLIAPSRVSKLIGRGLGIQSDASIDNNCESKCFWRGGSINTRLPFQNLSPRTVGQCPKYVNKRSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 10330 - protein, 561 aa, Artificial Sequence
  hemagglutinin__InfluenzaA__AGQ81196
MYKIVVIIALLGAVKGLDKICLGHHAVANGTIVKTLTNEQEEVTNATETVESASLNRLCMKGRSHKDLGNCHPIGMLIGTPACDLHLTGTWDTLIERENAIAYCYPGATVNEEALRQKIMESGGISKISTGFTYGSSINSAGTTKACMRNRGNSFYAELKWLVSKSKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLVGRGLGIQSDAPIDNNCESKCFWRGGSINTRLPFQNLSPRTVGQCPKYVNKRSLMLATGMRNVPEIMQGRGLFGAIAGFIENGWEGMVDGWYGFRHQNAQGTGQAADYKSTQTAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVKLSSGYKDIILWFSFGASCFVLLAVVMGLVFFCLKNGNMRCTICI

SEQ ID NO: 10331 - protein, 561 aa, Artificial Sequence
  hemagglutinin__InfluenzaA__AGQ81198
MYKIVVIIALLGAVKGLDKICLGHHAVANGTIVKTLTNEQEEVTNATETVESTSLNRLCMKGRNHKDLGNCHPIGMLIGTPACDLHLTGTWDTLIERENAIAYCYPGATINEEALRQKIMESGGISKISTGFTYGSSINSAGNTKACMRNGGNSFYAELRWLVSKNKGQNFPQTTNTYRNTDTAEHLIIWGIHHPSSTKEKNDLYGTQSLSISVGSSTYQNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKKSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 10332 - protein, 561 aa, Artificial Sequence
  hemagglutinin__InfluenzaA__AGQ81199
MYKIVVIIALLGAVKGLDKICLGHHAVANGTIVKTLTNEQEEVTNATETVESASLNRLCMKGRSHKDLGNCHPIGMLIGTPACDLHLTGTWDTLIERENAIAYCYPGATVNEEALRQKIMESGGISKISTGFTYGSSINSAGTTKACMRNGGNSFYAELKWLVSKSKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLVGRGLGIQSDAPIDNNCESKCFWRGGSINTRLPFQNLSPRTVGQCPKYVNKRSLMLATGMRNVPEIMQGRGLFGAIAGFIENGWEGMVDGWYGFRHQNAQGTGQAADYKSTQTAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVKLSSGYKDIILWFSFGASCFVLLAVVMGLVFFCLKNGNMRCTICI

SEQ ID NO: 10333 - protein, 565 aa, Artificial Sequence
  hemagglutinin__InfluenzaA__AGQ81200
MKKTLLFAAIFLYVKADEICIGYLSNNSTDKVDTIIENNVTVTSSVELVETEHTGSFCSINGKQPIGLGDCSFAGWILGNPMCDDLIGKTSWSYIVEKPNPANGICYPGTLENEEELRLKFSGVLEFSKFEAFTSTGWGAVNSGAGVTAACKFGSSNSFFRNMVWLIHQSGTYPVIKRTFNNTKGRDVLVVWGIHHPATLKEHQDLYKKDSSYVAVGSETYNRRFIPEISTRPKVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDKMNTNFESVQHEFSEIEERINQLSKHVDDSVVDIWSYNAQLLVLLENEKTLDLHDSNVRNLHEKVRRMLKDNAKDEGNGCFTFYHKCDNECIERVRNGTYDHKEFEEESKINRQEIEGVKLDSSGNVYKILSIYSCIASSLVLAALIMGFILWACSNGSCRCTICI

SEQ ID NO: 10334 - protein, 565 aa, Artificial Sequence
  hemagglutinin__InfluenzaA__AGQ81202
MKKTLLFAAIFLYVKADEICIGYLSNNSTDKVDTIIENNVTVTSSVELVETEHTGSFCSINGKQPISLGDCSFAGWILGNPMCDDLIGKTSWSYIVEKPNPANGICYPGTLENEEELRLKFSGVLEFSKFEAFTSNGWGAVNSGAGVTAACKFGSSNSFFRNTVWLIHQSGTYPVIKRTFNNTKGRDVLVVWGVHHPATLKEHQDLYKKDSSYVAVGSETYNRRFIPEISTRPKVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDRMNTNFESVQHESSEIEERINQLSKHVDDSMVDIWSYNAQLLVLLENEKTLDLHDSNVRNLHEKVRRMLKDNAKDEGNGCFTFYHKCDNKCIERVRNGTYDHKEFEEESKINRQEIEGVKLDSSGNVYKILSIYSCIASSLVLAALIMGFILWACSNGSCRCTICI

SEQ ID NO: 10335 - protein, 565 aa, Artificial Sequence
  hemagglutinin__InfluenzaA__AGQ81203
MKKTLLFAAIFLYVKADEICIGYLSNNSTDKVDTIIENNVTVTSSVELVETEHTGSFCSINGKQPISLGDCSFAGWILGNPMCDDLIGKTSWSYIVEKPNPANGICYPGTLENEEELRLKFSGVLEFNKFEAFTSNGWGAVNSGAGVTAACKFGSSNSFFRNMVWLIHQSGTYPVIKRTFNNTKGRDVLVVWGIHHPATLKEHQDLYKKDSSYVAVGSETYNRRFIPEISTRPKVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDRMNTNFESVQHEFSEIEERINQLSKHVDDSVVDIWSYNAQLLVLLENEKTLDLHDSNVRNLHEKVRRMLKDNAKDEGNGCFTFYHKCDNECIERVRNGTYDHKEFEEESKINRQEIEGVKLDSSGNVYKILSIYSCIASSLVLAALIMGFILWACSNGSCRCTICI

SEQ ID NO: 10336 - protein, 565 aa, Artificial Sequence
  hemagglutinin__InfluenzaA__AGQ81204
MKKTLLFAAIFLYVKADEICIGYLSNNSTDKVDTIIENNVTVTSSVELVETEHTGSFCSINGKQPISLGDCSFAGWILGNPMCDDLIGKTSWSYIVEKPNPANGICYPGTLENEEELRLKFSGVLEFNKFEAFTSNGWGAVNSGAGVTAACKFGSSNSFFRNMVWLIHQSGTYPVIKRTFNNTKGRDVLVVWGIHHPATLKEHQDLYKKDSSYVAVGSETYNRRFIPEISTRPKVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDRMNTNFGSVQHEFSEIEERINQLSKHVDDSVVDIWSYNAQLLVLLENEKTLDLHDSNVRNLHEKVRRMLKDNAKDEGNGCFTFYHKCDNECIERVRNGTYDHKEFEEESKINRQEIEGVKLDSSGNVYKILSIYSCIASSLVLAALIMGFILWACSNGSCRCTICI

SEQ ID NO: 10337 - protein, 565 aa, Artificial Sequence
  hemagglutinin__InfluenzaA__AGQ81205
MKKTLLFAAIFLYVKADEICIGYLSNNSTDKVDTIIENNVTVTSSVELVETEHTGSFCSINGKQPISLGDCSFAGWILGNPMCDDLIGKTSWSYIVEKPNPANGICYPGTLENEEELRLKFSGVLEFNKFEAFTSNGWGAVNSGAGVTATCKFGSSNSFFRNMVWLIHQSGTYPVIKRTFNNTKGRDVLVVWGIHHPATLKEHQDLYKKDSSYVAVGSETYNRRFIPEISTRPKVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDRMNTNFESVQYEFSEIEERINQLSKHVDDSVVDIWSYNAQLLVLLENEKTLDLHDSNVRNLHEKVRRMLKDNAKDEGNGCFTFYHKCDNECIERVRNGTYDHKEFEEESKINRQEIEGVKLDSSGNVYKILSIYSCIASSLVLAALIMGFILWACSNGSCRCTICI

SEQ ID NO: 10338 - protein, 565 aa, Artificial Sequence
  hemagglutinin__InfluenzaA__AGQ81206
MKKTLLFAAIFLYAKADEICIGYLSNNSTDKVDTIIENNVTVTSSVELVETEHTGSFCSINGKQPISLGDCSFAGWILGNPMCDDLIGKTSWSYIVEKPNPANGICYPGTLENEEELRSKFSGVLEFSKFEAFTSNGWGAVNSGAGVTAACKFGSSNSFFRNMVWLIHQSGTYPVIKRTFNNTKGRDVLVVWGIHHPATLKEHQDLYKKDSSYVAVGSETYNRRFIPEISTRPKVNGQAGRMTFYWTIVKPEESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDRMNTNFESVQHEFSEIEERINQLSKHVDDSVVDIWSYNAQLLVLLENEKTLDLHDSNVRNLHEKVRRMLKDNAKDEGNGCFTFYHKCDNECIERVRNGTYDHKEFEEESKINRQEIEGVKLDSSGNVYKILSIYSCIASSLILAALIMGFILWACSNGSCRCTICI

SEQ ID NO: 10339 - protein, 565 aa, Artificial Sequence
  hemagglutinin__InfluenzaA__AGQ81209
MKKTLLFAAIFLYVKADEICIGYLSNNSTDKVDTIIENNVTVTSSVELVETEHTGSFCSINGKQPISLGDCSFAGWILGNPMCDDLIGKTSWSYIVEKPNPANGICYPGTLENEEELRLKFSGILEFSKFEAFTSNGWGAVNSGAGVTAACKFGSSNSFFRNMVWLIHQSGTYPVIKRTFNNTKGRDVLIVWGIHHPATLKEHQDLYKKDSSYVAVGSETYNRRFIPEISTRPKVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDRMNTNFESVQHEFSEIEERINQLSKHVDDSVVDIWSYNAQLLVLLENEKTLDLHDSNVRNLHEKVRRMLKDNAKDEGNGCFTFYHKCDNECIERVRNGTYDHKEFEEESKINRQEIEGVKLDSSGNVYRILSIYSCIASSLVLAALIMGFILWACSNGSCRCTICI

SEQ ID NO: 10340 - protein, 565 aa, Artificial Sequence
  hemagglutinin__InfluenzaA__AGQ81211
MKKTLLFAAIFLYVKADEICIGYLSNNSTDKVDTIIENNVTVTSSVELVETEHTGSFCSINGKQPISLGDCSFAGWILGNPMCDDLIGKTSWSYIVEKPNPANGICYPGTLENEEELRLKFSGVLEFSKFEAFTSNGWGAVNSGAGVTAACKFGSSNSFFRNMVWLIHQSGTYPVIKRTFNNTKGRDVLIVWGIHHPATLKEHQDLYKKDSSYVAVGSETYNRRFIPEISTRPKVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDRMNTNFESVQHEFSEIEERINQLSKHVDDSVVDIWSYNAQLLVLLENEKTLDLHDFNVRNLHEKVRRMLKDNAKDEGNGCFTFYHKCDNECIERVRNGTYDHKEFEEESKINRQEIEGVKLDSSGNVYRILSIYSCIASSLVLAALIMGFILWACSNGSCRCTICI

SEQ ID NO: 10341 - protein, 565 aa, Artificial Sequence
  hemagglutinin__InfluenzaA__AGQ81213
MKKTLLFAAIFLYVRADEICIGYLSNNSTDKVDTIIENNVTVTSSVELVETEHTGSFCSINGKQPISLGDCSFAGWILGNPMCDGLIGKTSWSYIVEKPNPANGICYPGTLENEEELRLKFSRVLEFSKFEAFTSNGWGAVNSGAGVTAACKFGSSNSFFRNMVWLIHQSGTYPVIKRTFNNTKGRDVLVVWGIHHPATLKEHQDLYKKDSSYVAVGSETYNRRFIPEISTRPTVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDRMNTNFESVQHEFSEIEERINQLSKHVDDSVVDIWSYNAQLLVLLENEKTLDLHDSNVRNLHEKVRRMLKDNAKDEGNGCFTFYHKCDNECIERVRNGTYDHKEFEEESKINRQEIEGVKLDSSGNVYKILSIYSCIASSLVLAALIMGFILWACSNGSCRCTICI

SEQ ID NO: 10342 - protein, 565 aa, Artificial Sequence
  hemagglutinin__InfluenzaA__AGQ81214
MKKTLLFAAIFLYVKADEICIGYLSNNSTDKVDTIIENNVTVTSSVELVETEHTGSFCSINGKQPISLGDCSFAGWILGNPMCDDLIGKTSWSYIVEKPNPANGICYPGTLENEEELRLKFSGVLEFSKFEAFTSNGWGAVNSGAGVTAACKFGSSNSFFRNMVWLIHQSGTYPVIKRTFNNTKGRDVLIVWGIHHPATLKEHQDLYKKDSSYVAVGSETYNRRFIPEISTRPKVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAITSRGLFGAIAGFIEGGWPGLINGWYGFQHRNEEGTGIAADKESTQKAIDQITSKVNNIVDRMNTNFESVQHEFSEIEGRINQLSKHVDDSVVDIWSYNAQLLVLLENEKTLDLHDSNVRNLHEKVRRMLKDNAKDEGNGCFTFYHKCDNECIERVRNGTYDHKEFEEESKINRQEIEGVKLDSSGNVYKILSIYSCIASSLVLAALIMGFILWACSNGSCRCTICI

SEQ ID NO: 10343 - protein, 565 aa, Artificial Sequence
  hemagglutinin__InfluenzaA__AGQ81215
MKKTLLFAAIFLYVKADEICIGYLSNNSTDKVDTIIENNVTVTSSVELVETEHTGSFCSINGKQPISLGDCSFAGWILGNPMCDGLIGKTSWSYIVEKPNPANGICYPGTLENEEELRLKFSGILEFSKFEAFTSNGWGAVNSGAGVTAACKFGSSNSFFRHMVWLIHQSGTYPVIKRTFNNTKGRDVLVVWGIHHPATLKEQQDLYKKDSSYVAVGSETYNRRFIPEISTRPKVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDRMNTNFESVQHEFSEIEERINQLSKHVDDSVVDIWSYNAQLLVLLENEKTLDLHDSNVRNLHEKVRRMLKDNAKDEGNGCFTFYHKCDNECIERVRNGTYDHKEFEEESKINRQEIEGVKLDSSGNVYKILSIYSCIASSLVLAALIMGFILWACSNGSCRCTICI

SEQ ID NO: 10344 - protein, 565 aa, Artificial Sequence
  hemagglutinin__InfluenzaA__AGQ81216
MKKTLLFAAIFLYVKADEICIGYLSNNSTDKVDTIIENNVTVTSSVELVETEHTGSFCSINGKQPISLGDCSFAGWILGNPMCDDLIGKTSWSYIVEKPNPANGICYPGTLENEEELRLKFSGVLEFSKFEAFTSNGWGAVNSGAGVTAACKFGSSNSFFRNMVWLIHQSGTYPVTKRTFNNTKGRDVLVVWGIHHPATLKEHQDLYKKDSSYVAVGSETYNRRFTPEISTRPKVNGQAGRMTFYWTIVKPGESITFESNGAFLAPRYAFEIVSVGNGKLFRSELNIESCSTKCQTEIGGINTNKSFHSVHRNTIGDCPKYVNVKSLKLATGLRNVPAIASKGLFGAIAGFIEGGWPGLINGWYGFQHRNEEGTGIAADKESTQKAIDQITSKVNNIVDRMNTNFESVRHEFSEIEERINQLSKHVDDSVVDIWSYNAQLLVLLENEKTLDLHDSNVRNLHERVRRMLKDNAKDEGNGCFTFYHKCDNECIERVRNGTYDHKEFEEESKINRQEIEGVKLDSSGNVYKILSIYSCIASSLVLAALIMGFILWACGNGSCRCTICI

SEQ ID NO: 10345 - protein, 565 aa, Artificial Sequence
  hemagglutinin__InfluenzaA__AGQ81217
MKKTLLFAAIFLYAKADEICIGYLSNNSTDKVDTIIENNVTVTSSVELVETEHTGSFCSINGKQPISLGDCSFAGWILGNPMCDDLIGKTSWSYIVEKPNPANGICYPGTLENEEELRLKFSGVLEFSRFEAFTSNGWGAVNSGAGVTAACKFGSSNSFFRNMVWLIHQSGTYPVIKRTFNNTKGRDVLVVWGIHHPATLKEHQDLYKKDSSYVAVGSETYNRRFIPEISTRPKVNGQAGRMTFYWTIVKPEESITFESNGAFLAPRYAFEIVSVGNGKLFRSELNIESCSTKCQTEIGGINTNKSFHSVHRNTIGDCPKYVNVKSLKLATGLRNVPAIASRGLFGAIAGFIEGGWPGLINGWYGFQHRNEEGTGIAADKESTQKAIDQITSKVNNIVDRMNTNFESVQHEFSEIEERINQLSKHVDDSVVDIWSYNAQLLVLLENEKTLDLHDSNVRNLHEKVRRMLKDNAKDEGNGCFTFYHKCDNECIERVRNGTYDHKEFEEESKINRQEIEGVKLDSSGNVYKILSIYSCIASSLILAALIMGFILWACSNGSCRCTICI

SEQ ID NO: 10346 - protein, 567 aa, Artificial Sequence
  hemagglutinin__InfluenzaA__AGQ88499
MEKIVLLFATISLVKSDHICIGYHANNSTEQVDTIMEKNVTVTHAQDILEKTHNGKLCDLNGVKPLILKDCSVAGWLLGNPMCDEFINVPEWSYIVEKANPANDLCYPGNFNDYEELKHLLSRINHFEKIQIIPKDSWTDHEASLGVSAACPYQGNSSFFRNVVWLIKKDNAYPTIKKGYNNTNQEDLLVLWGIHHPNNEAEQTRLYQNPTTYISIGTSTLNQRLVPKIATRSKINGQSGRIDFFWTILKPNDAIHFESNGNFIAPEYAYKIVKKGDSTIMKSEVEYGNCNTRCQTPIGAINSSMPFHNIHPLTIGECPKYVKSNKLVLATGLRNSPQRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDYHDSNVRNLYDKVRLQLKDNAKELGNGCFEFYHKCNNECMESVRNGTYDYPQYSEEARLKREEISGVKLESIGIYQILSIYSTVASSLVLAIMMAGLSLWMCSNGSLQCRICI

SEQ ID NO: 10347 - protein, 560 aa, Artificial Sequence; identical to SEQ ID NO: 10237
  hemagglutinin__InfluenzaA__AGR33888

SEQ ID NO: 10348 - protein, 560 aa, Artificial Sequence; identical to SEQ ID NO: 10237
  hemagglutinin__InfluenzaA__AGR33889

SEQ ID NO: 10349 - protein, 560 aa, Artificial Sequence
  hemagglutinin__InfluenzaA__AGR33890
MNTQILVFALIAITPTNSDKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPPMTKSYKNTRKAPALIIWGIHHSVSTAEQTKLYGSGNKLVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 10350 - protein, 560 aa, Artificial Sequence
  hemagglutinin__InfluenzaA__AGR33892
MNTQILVFALIAIIPTNADKICLGHHAVSNGTKVNTLTERGVEVVNATETVERTSIPRICSKGKRTVDLGQCGLLGTITGPPQCDQFLEFSADLIIERREGSDVCYPGKFVNEEALRQILRESGGINKEAMGFTYSGIRTNGATSACRRSGSSFYAEMKWLLSNTDNAAFPPMTKSYKNTRKAPALIIWGIHHSGSTAEQTKLYGSGNKMVTVRSSNYQQSFVPSPGAGPQVNGQSGRIDFHWLMLNPNDTVTFSFNGAFIAPDRASFLRGKSMGIQSGVQVDANCEGDCYHSGGTIISNLPFQNIDSRVVGKCPRYVKQKSLLLATGMKNVPEIPKGRGLFGAIAGFIENGWEGLIDGWYGFRHQNAQGEGTAADYKSTQSAINQMTGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVENGNMRCTICI

SEQ ID NO: 10351 - protein, 560 aa, Artificial Sequence; identical to SEQ ID NO: 10229
  hemagglutinin__InfluenzaA__AGR33895

SEQ ID NO: 10352 - protein, 560 aa, Artificial Sequence; identical to SEQ ID NO: 10308
  hemagglutinin__InfluenzaA__AGR33897

SEQ ID NO: 10353 - protein, 560 aa, Artificial Sequence
  hemagglutinin__InfluenzaA__AGR33899
METVSLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTIWNVSYNGTSKACSGSFYRSMRWLTQKNSNYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKKGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRSKYQEESKLERQKIEGVKLESEGTYKILTIYSTVASSLVIAMGFAAFLFWAMSNGSCRCNICI

SEQ ID NO: 10354 - protein, 560 aa, Artificial Sequence
  hemagglutinin__InfluenzaA__AGR33900
METVSLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTIWNVSYNGTSKACSGSFYRSMRWLTQKNSDYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKKGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFDLYHKCDDQCMETIRNGTYNRRKYQEESKLERQKIEGVKLESEGTYKILTIYSTVASSLVIAMGFAAFLFWAMSNGSCRCNICI

SEQ ID NO: 10355 - protein, 560 aa, Artificial Sequence
  hemagglutinin__InfluenzaA__AGR33902
METASLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTTWNVSYNGISKACSGSFYRSMRWLTQKNSNYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDNQCMETIRNGTYNRRKYQEESKLERQKIEGVKLESEGTYKILTIYSTVASSLVIAMGFAAFLFWAMSNGSCRCNICI

SEQ ID NO: 10356 - protein, 565 aa, Artificial Sequence; identical to SEQ ID NO: 5513
  hemagglutinin__InfluenzaA__AGR49817

SEQ ID NO: 10357 - protein, 565 aa, Artificial Sequence
  hemagglutinin__InfluenzaA__AGR49841
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPRDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESIGVYQILAIYSTVASSLVLLVSLGAISFWMCSNGSLQCRICI

SEQ ID NO: 10358 - protein, 565 aa, Artificial Sequence; identical to SEQ ID NO: 5513
  hemagglutinin__InfluenzaA__AGR49853

SEQ ID NO: 10359 - protein, 565 aa, Artificial Sequence
  hemagglutinin__InfluenzaA__AGR49865
MKVKLLVLLCTFTATYADTICIGYHANNSTDTVDTVLEKNVTVTHSVNLLENNHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVNQKTLYRTENAYVSVVSSHYSRKFTPEIAKRPKVRDQEGRINYYWTLLEPGDTIIFEANGNLIAPRYAFALNRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 10360 - protein, 566 aa, Artificial Sequence; identical to SEQ ID NO: 2656
  hemagglutinin__InfluenzaA__AGR49877

SEQ ID NO: 10361 - protein, 566 aa, Artificial Sequence; identical to SEQ ID NO: 2434
  hemagglutinin__InfluenzaA__AGR49888

SEQ ID NO: 10362 - protein, 566 aa, Artificial Sequence
  hemagglutinin__InfluenzaA__AGR49900
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSKCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10363 - protein, 566 aa, Artificial Sequence
  hemagglutinin__InfluenzaA__AGR49912
MKTIIALSYILCLVSAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSKCITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10364 - protein, 566 aa, Artificial Sequence
  hemagglutinin__InfluenzaA__AGR49924
MKTIIALSYILCLVSAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSKCITPNGSIPNDKPFQNVNRITYGACPRYVKQNTLKLATGMRNVPEKQTRGIFGAIAGFIENGWEGMVDGWYGFRHQNSEGIGQAADLKSTQAAVDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10365 - protein, 566 aa, Artificial Sequence
  hemagglutinin__InfluenzaA__AGR49936
MKTIIALSYILCLISAQKFPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPGYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10366 - protein, 566 aa, Artificial Sequence; identical to SEQ ID NO: 7694
  hemagglutinin__InfluenzaA__AGR49948

SEQ ID NO: 10367 - protein, 566 aa, Artificial Sequence; identical to SEQ ID NO: 2527
  hemagglutinin__InfluenzaA__AGR49960

SEQ ID NO: 10368 - protein, 566 aa, Artificial Sequence
  hemagglutinin__InfluenzaA__AGR49972
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTIVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10369 - protein, 565 aa, Artificial Sequence; identical to SEQ ID NO: 6698
  hemagglutinin__InfluenzaA__AGR49983

SEQ ID NO: 10370 - protein, 565 aa, Artificial Sequence; identical to SEQ ID NO: 6698
  hemagglutinin__InfluenzaA__AGR49995

SEQ ID NO: 10371 - protein, 566 aa, Artificial Sequence; identical to SEQ ID NO: 2656
  hemagglutinin__InfluenzaA__AGR50007

SEQ ID NO: 10372 - protein, 566 aa, Artificial Sequence; identical to SEQ ID NO: 2656
  hemagglutinin__InfluenzaA__AGR50018

SEQ ID NO: 10373 - protein, 566 aa, Artificial Sequence; identical to SEQ ID NO: 2656
  hemagglutinin__InfluenzaA__AGR50029

SEQ ID NO: 10374 - protein, 566 aa, Artificial Sequence
  hemagglutinin__InfluenzaA__AGR50040
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACMGSIRNGTYDHDVYRDEALNNRFQIKGVELKSGYKDWILWISFAISCFLLCVALLGFIMWACQKGNIRCNICI

SEQ ID NO: 10375 - protein, 566 aa, Artificial Sequence; identical to SEQ ID NO: 2656
  hemagglutinin__InfluenzaA__AGR50052

SEQ ID NO: 10376 - protein, 566 aa, Artificial Sequence; identical to SEQ ID NO: 2656
  hemagglutinin__InfluenzaA__AGR50063

SEQ ID NO: 10377 - protein, 566 aa, Artificial Sequence
  hemagglutinin__InfluenzaA__AGR50074
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRNQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10378 - protein, 566 aa, Artificial Sequence; identical to SEQ ID NO: 2656
  hemagglutinin__InfluenzaA__AGR50085

SEQ ID NO: 10379 - protein, 566 aa, Artificial Sequence; identical to SEQ ID NO: 2656
  hemagglutinin__InfluenzaA__AGR50096

SEQ ID NO: 10380 - protein, 566 aa, Artificial Sequence; identical to SEQ ID NO: 2656
  hemagglutinin__InfluenzaA__AGR50107

SEQ ID NO: 10381 - protein, 566 aa, Artificial Sequence; identical to SEQ ID NO: 2849
  hemagglutinin__InfluenzaA__AGR50118

SEQ ID NO: 10382 - protein, 566 aa, Artificial Sequence
  hemagglutinin__InfluenzaA__AGR50129
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGQCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10383 - protein, 566 aa, Artificial Sequence; identical to SEQ ID NO: 2656
  hemagglutinin__InfluenzaA__AGR50140

SEQ ID NO: 10384 - protein, 566 aa, Artificial Sequence; identical to SEQ ID NO: 2851
  hemagglutinin__InfluenzaA__AGR50151

SEQ ID NO: 10385 - protein, 565 aa, Artificial Sequence; identical to SEQ ID NO: 6698
  hemagglutinin__InfluenzaA__AGR50162

SEQ ID NO: 10386 - protein, 566 aa, Artificial Sequence; identical to SEQ ID NO: 2656
  hemagglutinin__InfluenzaA__AGR50174

SEQ ID NO: 10387 - protein, 566 aa, Artificial Sequence; identical to SEQ ID NO: 2695
  hemagglutinin__InfluenzaA__AGR50185

SEQ ID NO: 10388 - protein, 566 aa, Artificial Sequence; identical to SEQ ID NO: 2656
  hemagglutinin__InfluenzaA__AGR50196

SEQ ID NO: 10389 - protein, 566 aa, Artificial Sequence
  hemagglutinin__InfluenzaA__AGR50207
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGKSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10390 - protein, 566 aa, Artificial Sequence; identical to SEQ ID NO: 2656
  hemagglutinin__InfluenzaA__AGR50218

SEQ ID NO: 10391 - protein, 566 aa, Artificial Sequence; identical to SEQ ID NO: 2656
  hemagglutinin__InfluenzaA__AGR50229

SEQ ID NO: 10392 - protein, 566 aa, Artificial Sequence; identical to SEQ ID NO: 2851
  hemagglutinin__InfluenzaA__AGR50240

SEQ ID NO: 10393 - protein, 566 aa, Artificial Sequence; identical to SEQ ID NO: 2709
  hemagglutinin__InfluenzaA__AGR50251

SEQ ID NO: 10394 - protein, 566 aa, Artificial Sequence
  hemagglutinin__InfluenzaA__AGR50262
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENEKTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10395 - protein, 566 aa, Artificial Sequence; identical to SEQ ID NO: 2656
  hemagglutinin__InfluenzaA__AGR50273

SEQ ID NO: 10396 - protein, 566 aa, Artificial Sequence
  hemagglutinin__InfluenzaA__AGR50284
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDSPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10397 - protein, 566 aa, Artificial Sequence; identical to SEQ ID NO: 3399
  hemagglutinin__InfluenzaA__AGR50295

SEQ ID NO: 10398 - protein, 566 aa, Artificial Sequence; identical to SEQ ID NO: 2656
  hemagglutinin__InfluenzaA__AGR50306

SEQ ID NO: 10399 - protein, 566 aa, Artificial Sequence; identical to SEQ ID NO: 2656
  hemagglutinin__InfluenzaA__AGR50317

SEQ ID NO: 10400 - protein, 566 aa, Artificial Sequence; identical to SEQ ID NO: 10389
  hemagglutinin__InfluenzaA__AGR50328

SEQ ID NO: 10401 - protein, 566 aa, Artificial Sequence
  hemagglutinin__InfluenzaA__AGR50339
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTSKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10402 - protein, 566 aa, Artificial Sequence
  hemagglutinin__InfluenzaA__AGR50350
MKAILVVLLYTFATANADTLCIGYHANNSTDTVDTVLEKNVTVTHSVNLLEDKHNGKLCKLRGVAPLHLGKCNIAGWIMGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10403 - protein, 565 aa, Artificial Sequence
  hemagglutinin__InfluenzaA__AGR50361
MKVQLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 10404 - protein, 566 aa, Artificial Sequence
  hemagglutinin__InfluenzaA__AGT18718
MKVILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10405 - protein, 566 aa, Artificial Sequence
  hemagglutinin__InfluenzaA__AGT18720
MKVILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKASSWPNHDSNKGVTAACPHAGAKSFYKNLIWLVKKGNSYPKLSKSYINDKGKEVLVLWGIHHPNTTADQQSLYQNADAYVFVGTSRYSKKFKPEIAIRPKVRDQERRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10406 - protein, 566 aa, Artificial Sequence
  hemagglutinin__InfluenzaA__AGT18721
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSIQRSEICTKTSSWPNHDSNKGVTAACPHAGAKSFYKNLIWLVKKGNSYPKLSKSYINDKGKEVLVLWGIHHQNSRGHQQSLYQNADAYVFVGTSRYSKKFKPEIAIRPKVKEQDGRMDYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10407 - protein, 566 aa, Artificial Sequence
  hemagglutinin__InfluenzaA__AGT18722
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSKSNNRTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10408 - protein, 566 aa, Artificial Sequence
  hemagglutinin__InfluenzaA__AGT18723
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSKTNNRTCYPGDFINYEELREQLSSVSSFERFEIFPKTSSWPNHDSNKGVTAACPHAGAKSFYKNLIWLVKKGNSYPKLSKSYINDKGKEVLVLWGIHHQNKKAEQQTPYQNADAYVFVGTSRYSKKFKPEIAIRPKVRDQEGRMDYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10409 - protein, 566 aa, Artificial Sequence
  hemagglutinin__InfluenzaA__AGT18724
MKAILVVLLYTFATANADTLCIGYHANNSTDTVDTVLEKNVTVTHSVNLLEDKHNGKLCKLRGVVPLHLGKCNIAGWILGNPECESLSTASSWSYIVETSKTNNRTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQTLYQNADAYVFVGTSRYSKKFKPEIAIRPKVRDQEGRMNYYRTLIEPENKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10410 - protein, 566 aa, Artificial Sequence
  hemagglutinin__InfluenzaA__AGT18725
MKVILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRTQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10411 - protein, 566 aa, Artificial Sequence
  hemagglutinin__InfluenzaA__AGT18734
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRINYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10412 - protein, 566 aa, Artificial Sequence; identical to SEQ ID NO: 10123
  hemagglutinin__InfluenzaA__AGT18735

SEQ ID NO: 10413 - protein, 566 aa, Artificial Sequence
  hemagglutinin__InfluenzaA__AGT18748
MKTIIALSYILCLVFAQKLPGNDNSTATLCLGHHAVPNGTIVKTITNDRIEVTNATELVQNSSIGEICDSPHQILDEENCTLIDALLGDPQCDDFQNKKWDLFVERSKAYSNCYPYDVPDYASLRSLVASSGTLEFNNESFNWAGVTQNGTSSACRRGSNSSFFSRLNWLTHLNFKYPALNVTMPNNEQFDKLYIWGVHHPSTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10414 - protein, 566 aa, Artificial Sequence
  hemagglutinin__InfluenzaA__AGT18749
MKTIIALSYILCLVFAQKLPENDNSTATLCLGHHAVPNGTIVKTITDDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFRIRSGRSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10415 - protein, 566 aa, Artificial Sequence
  hemagglutinin__InfluenzaA__AGT18751
MKTVIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGRSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYKSELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10416 - protein, 566 aa, Artificial Sequence
  hemagglutinin__InfluenzaA__AGT18752
MKTIIALSYIICLVFAQKLPGNDNSTATLCLGHHAVPNGTIVKTITNDQIEVTNATELVQNSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGRSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYSSELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10417 - protein, 566 aa, Artificial Sequence
  hemagglutinin__InfluenzaA__AGT18753
MKTIIALSYILCLVFAQKLPGNDNSTATLCLGHHAVPNGTIVKTITNDQIEVTNATELVQNSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGRSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYKSELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10418 - protein, 566 aa, Artificial Sequence
  hemagglutinin__InfluenzaA__AGT18754
MKTIIALSYILCLVFAQKLPENDNSTATLCLGHHAVPNGTIVKTITDDQIEVTNATELVQNSSTGEICDSPHQILDGENCTLIDALLGDPQCDGFQNKKWDLFVERGKAYSNCYPYDVPDYASLRSLVATSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGRSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10419 - protein, 566 aa, Artificial Sequence
  hemagglutinin__InfluenzaA__AGT18756
MKTIIALSYVLCLVFAQKLPGNDNSTATLCLGHHAVPNGTIVKTITNDRIEVTNATELVQNSSIGEICDSPHQILDGENCTLIDALLGDPQCDDFQNKKWDLFVERSKAYSNCYPYDVPDYASLRSLVASSGTLEFNNESFNWAGVTQNGTSSACRRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYKSELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10420 - protein, 566 aa, Artificial Sequence
  hemagglutinin__InfluenzaA__AGT18757
MKTIIALSYILCLVFAQKLPGNDNSTATLCLGHHAVPNGTIVKTITNDRIEVTNATELVQNSSIGEICDSPHQILDGENCTLIDALLGDPQCDDFQNKKWDLFVERSKAYSNCYPYDVPDYASLRSLVASSGTLEFNNESFNWAGVTQNGTSSACRRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10421 - protein, 566 aa, Artificial Sequence
  hemagglutinin__InfluenzaA__AGT18758
MKTIIALSYILCLVFAQKLPGNDNSTATLCLGHHAVPNGTIVKTITNDRIEVTNATELVQNSSIGEICDSPHQILDGENCTLIDALLGDPQCDDFQNKKWDLFVERSKAYSNCYPYDVPDYASLRSLVASSGTLEFNNESFNWAGVTQNGTSSACRRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYSSELLVALENQHTIDLTDSEMNKLFEKTKKQLRENAEDMGNGCFKIYHKCDNTCIGSIRNGTYDHDVYRDEALNNRFQIKGVELKSGYKDWILWISFAISCFLVCVALLGFIMWACQKGNIRCNICI

SEQ ID NO: 10422 - protein, 566 aa, Artificial Sequence
  hemagglutinin__InfluenzaA__AGT18759
MKTIIALSYILCLVFAQKLPGNDNSTATLCLGHHAVPNGTIVKTITNDRIEVTNATELVQNSSIGEICDSPHQILDGENCTLIDALLGDPQCDDFQNKKWDLFVERSKAYSNCYPYDVPDYASLRSLVASSGTLEFNNESFNWAGVTQNGTSSACRRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYSSELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLVCVALLGFIMWACQKGNIRCNICI

SEQ ID NO: 10423 - protein, 566 aa, Artificial Sequence
  hemagglutinin__InfluenzaA__AGT18760
MKTIIALSYILCLVFAQKLPGNDNSTATLCLGHHAVPNGTIVKTITNDRIEVTNATELVQNSSIGEICDSPHQILDGENCTLIDALLGDPQCDDFQNKKWDLFVERNKAYSNCYPYDVPDYASLRSLVASSGTLEFNNESFNWAGVTQNGTSSACRRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYKSELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLVCVALLGFIMWACQKGNIRCNICI

SEQ ID NO: 10424 - protein, 566 aa, Artificial Sequence
  hemagglutinin__InfluenzaA__AGT18761
MKTIIALSYILCLVFAQKLPGNDNSTATLCLGHHAVPNGTIVKTITNDRIEVTNATELVQNSSIGEICDSPHQILDGENCTLIDALLGDPQCDDFQNKKWDLFVERSKAYSNCYPYDVPDYASLRSLVASSGTLEFNNESFNWAGVTQNGTSSACRRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYSSEFLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLVCVALLGFIMWACQKGNIRCNICI

SEQ ID NO: 10425 - protein, 566 aa, Artificial Sequence
  hemagglutinin__InfluenzaA__AGT37102
MEAKLVVLFCAFTTLKADIICVGYHANNSTDTVDTIMEKNVTVTHSVNLLENSHNGKLCSLNGKAPLQLGNCNVAGWILGNPECDLLLTANSWSYIIETSSSKNGTCYPGEFSDYEELRELLSTVSSFERFEIFPKATSWPNHETTKGATIACSHSGASSFYRNLLWIVKKGNSYPKISKSYTNNRGKEVLVIWGVHHPPTDSSQQALYQNTHTYISVGSSKYYQRFTPVVAARPKIREQEGRMNYYWTLLEQGDTITFEATGNLIAPWYAFALDMGSSSGIMVSDAPVHNCTTKCQTPHGALKSNLPFQNVHPITIGECPKYVKSTQLRMATGLRNIPSIQSRGLFGAIAGFIEGGWTGMIDGWYGYHHQNEQGSGYAADQKSTQIAIDGISNKVNSIIEKMNVQFTSVGKEFNDLEKRIENLNKKVDDGFLDVWTYNAELLVLLENERTLDFHDFNVKNLYEKVKSQLRNNAKEIGNGCFEFYHKCDNECMENVKNGTYNYPKYSEESKLNREKIDGVKLESIGVHQILAIYSTVASSLVLLVSLGAISFWMCSNGSLQCRICI

SEQ ID NO: 10426 - protein, 566 aa, Artificial Sequence
  hemagglutinin__InfluenzaA__AGU01877
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTTDQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10427 - protein, 566 aa, Artificial Sequence
  hemagglutinin__InfluenzaA__AGU01878
MKAILVVMLYTLATANADTLCIGYHANNSTDTVDTVLEKNVTVTHSVNLLEDKHDGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPHAGAKGFYKNLIWLVKKGNSYPKLSISYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10428 - protein, 566 aa, Artificial Sequence
  hemagglutinin__InfluenzaA__AGU01879
MKAILVVMLYTFATANADTLCIGYHANNSTDTVDTVLEKNVTVTHSVNLLEDKHNEKLCKLRGVAPLHLGKCNIAGWILGNPECESLSTASSWSYIVETSGSDNGTCYPGDFIDYEELREQLSSVSSFERFEIFPKTSSWPNHDSNKGVTAACPQAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10429 - protein, 566 aa, Artificial Sequence
  hemagglutinin__InfluenzaA__AGU01881
MKAILVVLLYTFATANADTLCIGYHANNSTDTVDTVLEKNVTVTHSVNLLEDKHNGKLCKLRGVTPLHLGKCNIAGWILGNPECESLSTASSWSYIVETSSSDNGTCYPGDFINYEELREQLSSVSSFERFEMFPKTSSWPNHDSNKGVTAACPQAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10430 - protein, 566 aa, Artificial Sequence
  hemagglutinin__InfluenzaA__AGU01883
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPHAGAKGFYKNLIWLVKKGNSYPKLSISYINNKEKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10431 - protein, 566 aa, Artificial Sequence; identical to SEQ ID NO: 10060
  hemagglutinin__InfluenzaA__AGU01884

SEQ ID NO: 10432 - protein, 566 aa, Artificial Sequence
  hemagglutinin__InfluenzaA__AGU01885
MKAILVVMLYTFATANADTLCIGYHANNSTDTVDTVLEKNVTVTHSVNLLEDKHNEKLCKLRGVAPLHLGKCNIAGWILGNPECESLSTASSWSYIVETSGSDNGTCYPGDFIDYEELREQLSSVSSFERFEIFPKTSSWPNHDSNKGVTAACPQAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10433 - protein, 566 aa, Artificial Sequence
  hemagglutinin__InfluenzaA__AGU01887
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAVERNAGSGIIISDTPVHNCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10434 - protein, 566 aa, Artificial Sequence
  hemagglutinin__InfluenzaA__AGU01888
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPQAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTRFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10435 - protein, 566 aa, Artificial Sequence; identical to SEQ ID NO: 10426
  hemagglutinin__InfluenzaA__AGU01889

SEQ ID NO: 10436 - protein, 566 aa, Artificial Sequence
  hemagglutinin__InfluenzaA__AGU01890
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPQAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10437 - protein, 566 aa, Artificial Sequence
  hemagglutinin__InfluenzaA__AGU92645
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIETRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10438 - protein, 566 aa, Artificial Sequence
  hemagglutinin__InfluenzaA__AGU92667
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIATRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERALDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10439 - protein, 566 aa, Artificial Sequence
  hemagglutinin__InfluenzaA__AGU92678
MKAILVVLLYTFATANADTLCIGHHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIATRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10440 - protein, 566 aa, Artificial Sequence
  hemagglutinin__InfluenzaA__AGU92711
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKQGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10441 - protein, 566 aa, Artificial Sequence
  hemagglutinin__InfluenzaA__AGU92722
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10442 - protein, 566 aa, Artificial Sequence; identical to SEQ ID NO: 10441
  hemagglutinin__InfluenzaA__AGU92733

SEQ ID NO: 10443 - protein, 566 aa, Artificial Sequence
  hemagglutinin__InfluenzaA__AGU92744
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGAYDYPKYSEEAKLNREEIDGVKLESTRIYQILAIYSTVASSLVLVVSLGAISFWMCSNGSLQCRICI

SEQ ID NO: 10444 - protein, 566 aa, Artificial Sequence
  hemagglutinin__InfluenzaA__AGU92755
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKEFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10445 - protein, 566 aa, Artificial Sequence
  hemagglutinin__InfluenzaA__AGU92766
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHESNKGVTAACPHAGAKGFYKNLIWLVKKGNSYPKLSKSYINDKGKEVLVLWGIHHPSTTADQQSLYQNADAYVFVGTSRYSKKFKPEIATRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10446 - protein, 566 aa, Artificial Sequence
  hemagglutinin__InfluenzaA__AGU92777
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHESNKGVTAACPHAGAKGFYKNLIWLVKKGNSYPKLSKSYINDKGKEVLVLWGIHHPSTTADQQSIYQNADTYVFVGTSRYSKKFKPEIATRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10447 - protein, 566 aa, Artificial Sequence
  hemagglutinin__InfluenzaA__AGU92788
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSDKGVTAACPHAGAKGFYKNLIWLVKKGNSYPKLSKSYINDKGKEVLVLWGIHHPSTTADQQSLYQNADAYVFVGTSRYSKKFKPEIATRPKVRDREGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMLDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10448 - protein, 566 aa, Artificial Sequence
  hemagglutinin__InfluenzaA__AGU92799
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPDHDSNKGVTAACPHAGAKGFYKNLIWLVKKGNSYPKLSKSYINDKGKEVLVLWGIHHPSTTADQQSLYQNADAYVFVGTSRYSKKFKPEIATRPKVRDREGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10449 - protein, 566 aa, Artificial Sequence
  hemagglutinin__InfluenzaA__AGU92821
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKMFKPEIATRPKVRDREGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10450 - protein, 566 aa, Artificial Sequence
  hemagglutinin__InfluenzaA__AGU92843
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGDSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10451 - protein, 569 aa, Artificial Sequence
  hemagglutinin__InfluenzaA__AGU92854
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10452 - protein, 566 aa, Artificial Sequence
  hemagglutinin__InfluenzaA__AGU92887
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSDDQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10453 - protein, 566 aa, Artificial Sequence; identical to SEQ ID NO: 10437
  hemagglutinin__InfluenzaA__AGU92898

SEQ ID NO: 10454 - protein, 566 aa, Artificial Sequence; identical to SEQ ID NO: 10438
  hemagglutinin__InfluenzaA__AGU92909

SEQ ID NO: 10455 - protein, 566 aa, Artificial Sequence; identical to SEQ ID NO: 10440
  hemagglutinin__InfluenzaA__AGU92931

SEQ ID NO: 10456 - protein, 566 aa, Artificial Sequence; identical to SEQ ID NO: 10441
  hemagglutinin__InfluenzaA__AGU92942

SEQ ID NO: 10457 - protein, 566 aa, Artificial Sequence; identical to SEQ ID NO: 10441
  hemagglutinin__InfluenzaA__AGU92953

SEQ ID NO: 10458 - protein, 566 aa, Artificial Sequence
  hemagglutinin__InfluenzaA__AGU92964
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADAYVFVGTSRYSKKFKPEIATRPKVRDREGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMLDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10459 - protein, 566 aa, Artificial Sequence
  hemagglutinin__InfluenzaA__AGU92975
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKENSYPKLSKSYINDKGKEVLVLWGIHHPSTTADQQSLYQNADTYVFVGTSRYSKKFKPEIATRPKVRDREGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10460 - protein, 566 aa, Artificial Sequence; identical to SEQ ID NO: 10450
  hemagglutinin__InfluenzaA__AGU92986

SEQ ID NO: 10461 - protein, 566 aa, Artificial Sequence
  hemagglutinin__InfluenzaA__AGU92997
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKMFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10462 - protein, 566 aa, Artificial Sequence; identical to SEQ ID NO: 10452
  hemagglutinin__InfluenzaA__AGU93008

SEQ ID NO: 10463 - protein, 565 aa, Artificial Sequence; identical to SEQ ID NO: 6554
  hemagglutinin__InfluenzaA__AGU93019

SEQ ID NO: 10464 - protein, 566 aa, Artificial Sequence; identical to SEQ ID NO: 7050
  hemagglutinin__InfluenzaA__AGU93031

SEQ ID NO: 10465 - protein, 566 aa, Artificial Sequence
  hemagglutinin__InfluenzaA__AGU93042
MKAILVVLLYTFATANADTLCIGYHANNSTDTVDTVLEKNVTVTHSVNLLEDKHNGKLCKLRGVAPLHLGKCNIAGWILGNPECETLSTANSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNIQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10466 - protein, 566 aa, Artificial Sequence
  hemagglutinin__InfluenzaA__AGU93053
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIATRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 10467 - protein, 566 aa, Artificial Sequence
  hemagglutinin__InfluenzaA__AGV99014
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10468 - protein, 566 aa, Artificial Sequence; identical to SEQ ID NO: 9994
  hemagglutinin__InfluenzaA__AGV99037

SEQ ID NO: 10469 - protein, 566 aa, Artificial Sequence
  hemagglutinin__InfluenzaA__AGV99049
MKTIIALSYILCLVFAQKLPGNDNSTATLCLGHHAVPNGTVVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNGKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 10470 - protein, 566 aa, Artificial Sequence
  hemagglutinin__InfluenzaA__AGV99073
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKPGYKDWILWISFAISCFLLCVALLGFIMWACQKGNIRCNICI

SEQ ID NO: 10471 - protein, 566 aa, Artificial Sequence; identical to SEQ ID NO: 9858
  hemagglutinin__InfluenzaA__AGV99085

SEQ ID NO: 10472 - protein, 566 aa, Artificial Sequence
  hemagglutinin__InfluenzaA__AGV99097
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAEILVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10473 - protein, 566 aa, Artificial Sequence
  hemagglutinin__InfluenzaA__AGV99121
MKTIIALSYILCLVFAQKLPGNDNSTATLCLGHHAVPNGTIVKTITNDRIEVTNATELVQNSSIGEICDSPHQILDGENCTLIDALLGDPQCDDFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10474 - protein, 566 aa, Artificial Sequence; identical to SEQ ID NO: 10473
  hemagglutinin__InfluenzaA__AGV99133

SEQ ID NO: 10475 - protein, 566 aa, Artificial Sequence; identical to SEQ ID NO: 10467
  hemagglutinin__InfluenzaA__AGV99145

SEQ ID NO: 10476 - protein, 566 aa, Artificial Sequence
  hemagglutinin__InfluenzaA__AGV99157
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFIERSKAYSNCYPYDVPDYASLRSLVASSGTLEFNNESFNWTGVTQNGTSSACIRRSNNSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDTPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10477 - protein, 566 aa, Artificial Sequence; identical to SEQ ID NO: 9994
  hemagglutinin__InfluenzaA__AGV99169

SEQ ID NO: 10478 - protein, 566 aa, Artificial Sequence; identical to SEQ ID NO: 10467
  hemagglutinin__InfluenzaA__AGV99181

SEQ ID NO: 10479 - protein, 566 aa, Artificial Sequence
  hemagglutinin__InfluenzaA__AGV99193
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDTPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10480 - protein, 566 aa, Artificial Sequence; identical to SEQ ID NO: 9868
  hemagglutinin__InfluenzaA__AGV99956

SEQ ID NO: 10481 - protein, 566 aa, Artificial Sequence
  hemagglutinin__InfluenzaA__AGV99986
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLIASSGTLEFNNESFNWTGVTQNGTSSACIRRSNNSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10482 - protein, 566 aa, Artificial Sequence
  hemagglutinin__InfluenzaA__AGW00065
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYTSLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10483 - protein, 566 aa, Artificial Sequence; identical to SEQ ID NO: 9994
  hemagglutinin__InfluenzaA__AGW00077

SEQ ID NO: 10484 - protein, 566 aa, Artificial Sequence; identical to SEQ ID NO: 9858
  hemagglutinin__InfluenzaA__AGW00089

SEQ ID NO: 10485 - protein, 566 aa, Artificial Sequence; identical to SEQ ID NO: 9994
  hemagglutinin__InfluenzaA__AGW00101

SEQ ID NO: 10486 - protein, 566 aa, Artificial Sequence
  hemagglutinin__InfluenzaA__AGW00113
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQTFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10487 - protein, 566 aa, Artificial Sequence; identical to SEQ ID NO: 9994
  hemagglutinin__InfluenzaA__AGW00125

SEQ ID NO: 10488 - protein, 566 aa, Artificial Sequence; identical to SEQ ID NO: 9994
  hemagglutinin__InfluenzaA__AGW00137

SEQ ID NO: 10489 - protein, 566 aa, Artificial Sequence; identical to SEQ ID NO: 9994
  hemagglutinin__InfluenzaA__AGW00149

SEQ ID NO: 10490 - protein, 566 aa, Artificial Sequence; identical to SEQ ID NO: 9994
  hemagglutinin__InfluenzaA__AGW00161

SEQ ID NO: 10491 - protein, 566 aa, Artificial Sequence; identical to SEQ ID NO: 9994
  hemagglutinin__InfluenzaA__AGW00173

SEQ ID NO: 10492 - protein, 566 aa, Artificial Sequence
  hemagglutinin__InfluenzaA__AGW00185
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFIERSKAYSNCYPYDVPDYASLRSLVASSGTLEFNNESFNWTGVTQNGTSSACIRRSNNSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10493 - protein, 566 aa, Artificial Sequence; identical to SEQ ID NO: 9994
  hemagglutinin__InfluenzaA__AGW00709

SEQ ID NO: 10494 - protein, 566 aa, Artificial Sequence; identical to SEQ ID NO: 9994
  hemagglutinin__InfluenzaA__AGW00721

SEQ ID NO: 10495 - protein, 566 aa, Artificial Sequence; identical to SEQ ID NO: 9994
  hemagglutinin__InfluenzaA__AGW00733

SEQ ID NO: 10496 - protein, 566 aa, Artificial Sequence; identical to SEQ ID NO: 9994
  hemagglutinin__InfluenzaA__AGW00745

SEQ ID NO: 10497 - protein, 566 aa, Artificial Sequence
  hemagglutinin__InfluenzaA__AGW00757
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNLNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10498 - protein, 566 aa, Artificial Sequence; identical to SEQ ID NO: 9997
  hemagglutinin__InfluenzaA__AGW00769

SEQ ID NO: 10499 - protein, 566 aa, Artificial Sequence; identical to SEQ ID NO: 9883
  hemagglutinin__InfluenzaA__AGW00781

SEQ ID NO: 10500 - protein, 566 aa, Artificial Sequence; identical to SEQ ID NO: 10482
  hemagglutinin__InfluenzaA__AGW00793

SEQ ID NO: 10501 - protein, 566 aa, Artificial Sequence; identical to SEQ ID NO: 9994
  hemagglutinin__InfluenzaA__AGW00805

SEQ ID NO: 10502 - protein, 566 aa, Artificial Sequence; identical to SEQ ID NO: 9835
  hemagglutinin__InfluenzaA__AGW00817

SEQ ID NO: 10503 - protein, 566 aa, Artificial Sequence; identical to SEQ ID NO: 10481
  hemagglutinin__InfluenzaA__AGW00829

SEQ ID NO: 10504 - protein, 566 aa, Artificial Sequence
  hemagglutinin__InfluenzaA__AGW00841
MKTIIALSYILCLVFAQKLPGNDNSTATLCLGHHAVPNGTIVKTITNGRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10505 - protein, 566 aa, Artificial Sequence
  hemagglutinin__InfluenzaA__AGW00853
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQPSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10506 - protein, 566 aa, Artificial Sequence; identical to SEQ ID NO: 9858
  hemagglutinin__InfluenzaA__AGW00865

SEQ ID NO: 10507 - protein, 566 aa, Artificial Sequence
  hemagglutinin__InfluenzaA__AGW00877
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGFRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10508 - protein, 566 aa, Artificial Sequence
  hemagglutinin__InfluenzaA__AGW00889
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWVLWISFAISCFLLCVALLGFIMWACQKGNIRCNICI

SEQ ID NO: 10509 - protein, 566 aa, Artificial Sequence; identical to SEQ ID NO: 9858
  hemagglutinin__InfluenzaA__AGW00901

SEQ ID NO: 10510 - protein, 566 aa, Artificial Sequence; identical to SEQ ID NO: 9858
  hemagglutinin__InfluenzaA__AGW00913

SEQ ID NO: 10511 - protein, 566 aa, Artificial Sequence; identical to SEQ ID NO: 9994
  hemagglutinin__InfluenzaA__AGW00931

SEQ ID NO: 10512 - protein, 566 aa, Artificial Sequence; identical to SEQ ID NO: 9994
  hemagglutinin__InfluenzaA__AGW01244

SEQ ID NO: 10513 - protein, 566 aa, Artificial Sequence; identical to SEQ ID NO: 9868
  hemagglutinin__InfluenzaA__AGW01256

SEQ ID NO: 10514 - protein, 566 aa, Artificial Sequence
  hemagglutinin__InfluenzaA__AGW01295
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAEILVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10515 - protein, 566 aa, Artificial Sequence; identical to SEQ ID NO: 9858
  hemagglutinin__InfluenzaA__AGW01307

SEQ ID NO: 10516 - protein, 566 aa, Artificial Sequence
  hemagglutinin__InfluenzaA__AGW01319
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQDGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNKLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10517 - protein, 566 aa, Artificial Sequence
  hemagglutinin__InfluenzaA__AGW01331
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYEHDVYRDEALNNRFQIKGVELKSGYKDWILWISFAISCFLLCVALLGFIMWACQKGNIRCNICI

SEQ ID NO: 10518 - protein, 566 aa, Artificial Sequence; identical to SEQ ID NO: 9994
  hemagglutinin__InfluenzaA__AGW01343

SEQ ID NO: 10519 - protein, 566 aa, Artificial Sequence; identical to SEQ ID NO: 9997
  hemagglutinin__InfluenzaA__AGW01355

SEQ ID NO: 10520 - protein, 566 aa, Artificial Sequence; identical to SEQ ID NO: 9868
  hemagglutinin__InfluenzaA__AGW01367

SEQ ID NO: 10521 - protein, 566 aa, Artificial Sequence; identical to SEQ ID NO: 9994
  hemagglutinin__InfluenzaA__AGW01391

SEQ ID NO: 10522 - protein, 566 aa, Artificial Sequence
  hemagglutinin__InfluenzaA__AGW01403
MKTIIALSYILCLIFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHYVYRDEALNNRFQIKGVELKSGYKDWILWISFATSCFLLCVALLGFIMWACQKGNIRCNICI

SEQ ID NO: 10523 - protein, 566 aa, Artificial Sequence; identical to SEQ ID NO: 9858
  hemagglutinin__InfluenzaA__AGW01415

SEQ ID NO: 10524 - protein, 566 aa, Artificial Sequence; identical to SEQ ID NO: 9858
  hemagglutinin__InfluenzaA__AGW01427

SEQ ID NO: 10525 - protein, 566 aa, Artificial Sequence; identical to SEQ ID NO: 9858
  hemagglutinin__InfluenzaA__AGW01439

SEQ ID NO: 10526 - protein, 566 aa, Artificial Sequence
  hemagglutinin__InfluenzaA__AGW01451
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVVDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10527 - protein, 566 aa, Artificial Sequence; identical to SEQ ID NO: 9994
  hemagglutinin__InfluenzaA__AGW01463

SEQ ID NO: 10528 - protein, 566 aa, Artificial Sequence; identical to SEQ ID NO: 9994
  hemagglutinin__InfluenzaA__AGW01475

SEQ ID NO: 10529 - protein, 566 aa, Artificial Sequence
  hemagglutinin__InfluenzaA__AGW01487
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSNFKYPALNVTMPNNEQFDKLYIWGVHHPGTGKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10530 - protein, 566 aa, Artificial Sequence; identical to SEQ ID NO: 9858
  hemagglutinin__InfluenzaA__AGW01499

SEQ ID NO: 10531 - protein, 566 aa, Artificial Sequence
  hemagglutinin__InfluenzaA__AGW01511
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCAALLGFIMWACQKGNIRCNICI

SEQ ID NO: 10532 - protein, 566 aa, Artificial Sequence
  hemagglutinin__InfluenzaA__AGW01535
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNKESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10533 - protein, 566 aa, Artificial Sequence; identical to SEQ ID NO: 9858
  hemagglutinin__InfluenzaA__AGW01547

SEQ ID NO: 10534 - protein, 566 aa, Artificial Sequence; identical to SEQ ID NO: 9994
  hemagglutinin__InfluenzaA__AGW01559

SEQ ID NO: 10535 - protein, 566 aa, Artificial Sequence; identical to SEQ ID NO: 9994
  hemagglutinin__InfluenzaA__AGW01571

SEQ ID NO: 10536 - protein, 566 aa, Artificial Sequence; identical to SEQ ID NO: 9994
  hemagglutinin__InfluenzaA__AGW01583

SEQ ID NO: 10537 - protein, 566 aa, Artificial Sequence; identical to SEQ ID NO: 9994
  hemagglutinin__InfluenzaA__AGW01595

SEQ ID NO: 10538 - protein, 566 aa, Artificial Sequence
  hemagglutinin__InfluenzaA__AGW01607
MKTIIALSYILCLVLAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10539 - protein, 566 aa, Artificial Sequence; identical to SEQ ID NO: 9997
  hemagglutinin__InfluenzaA__AGW01619

SEQ ID NO: 10540 - protein, 566 aa, Artificial Sequence; identical to SEQ ID NO: 9994
  hemagglutinin__InfluenzaA__AGW01631

SEQ ID NO: 10541 - protein, 566 aa, Artificial Sequence
  hemagglutinin__InfluenzaA__AGW01643
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10542 - protein, 566 aa, Artificial Sequence; identical to SEQ ID NO: 9994
  hemagglutinin__InfluenzaA__AGW01655

SEQ ID NO: 10543 - protein, 566 aa, Artificial Sequence
  hemagglutinin__InfluenzaA__AGW01667
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNETYDHDVYRDEALNNRFQIKGVELKSGYKDWILWISFAISCFLLCVALLGFIMWACQKGNIRCNICI

SEQ ID NO: 10544 - protein, 566 aa, Artificial Sequence; identical to SEQ ID NO: 9994
  hemagglutinin__InfluenzaA__AGW01679

SEQ ID NO: 10545 - protein, 566 aa, Artificial Sequence
  hemagglutinin__InfluenzaA__AGW01691
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFVMWACQKGNIRCNICI

SEQ ID NO: 10546 - protein, 566 aa, Artificial Sequence; identical to SEQ ID NO: 9858
  hemagglutinin__InfluenzaA__AGW01701

SEQ ID NO: 10547 - protein, 566 aa, Artificial Sequence; identical to SEQ ID NO: 9858
  hemagglutinin__InfluenzaA__AGW01713

SEQ ID NO: 10548 - protein, 566 aa, Artificial Sequence
  hemagglutinin__InfluenzaA__AGW01725
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLICVALLGFIMWACQKGNIRCNICI

SEQ ID NO: 10549 - protein, 566 aa, Artificial Sequence; identical to SEQ ID NO: 9858
  hemagglutinin__InfluenzaA__AGW01737

SEQ ID NO: 10550 - protein, 566 aa, Artificial Sequence; identical to SEQ ID NO: 9994
  hemagglutinin__InfluenzaA__AGW01749

SEQ ID NO: 10551 - protein, 566 aa, Artificial Sequence; identical to SEQ ID NO: 9994
  hemagglutinin__InfluenzaA__AGW01761

SEQ ID NO: 10552 - protein, 566 aa, Artificial Sequence; identical to SEQ ID NO: 9858
  hemagglutinin__InfluenzaA__AGW01773

SEQ ID NO: 10553 - protein, 566 aa, Artificial Sequence; identical to SEQ ID NO: 9994
  hemagglutinin__InfluenzaA__AGW01785

SEQ ID NO: 10554 - protein, 566 aa, Artificial Sequence; identical to SEQ ID NO: 9858
  hemagglutinin__InfluenzaA__AGW01797

SEQ ID NO: 10555 - protein, 566 aa, Artificial Sequence; identical to SEQ ID NO: 9994
  hemagglutinin__InfluenzaA__AGW01809

SEQ ID NO: 10556 - protein, 566 aa, Artificial Sequence; identical to SEQ ID NO: 9994
  hemagglutinin__InfluenzaA__AGW01821

SEQ ID NO: 10557 - protein, 566 aa, Artificial Sequence; identical to SEQ ID NO: 9993
  hemagglutinin__InfluenzaA__AGW01833

SEQ ID NO: 10558 - protein, 566 aa, Artificial Sequence
  hemagglutinin__InfluenzaA__AGW01845
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFTNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10559 - protein, 566 aa, Artificial Sequence; identical to SEQ ID NO: 9994
  hemagglutinin__InfluenzaA__AGW01857

SEQ ID NO: 10560 - protein, 566 aa, Artificial Sequence; identical to SEQ ID NO: 9994
  hemagglutinin__InfluenzaA__AGW01869

SEQ ID NO: 10561 - protein, 566 aa, Artificial Sequence; identical to SEQ ID NO: 10545
  hemagglutinin__InfluenzaA__AGW01881

SEQ ID NO: 10562 - protein, 566 aa, Artificial Sequence; identical to SEQ ID NO: 9868
  hemagglutinin__InfluenzaA__AGW01893

SEQ ID NO: 10563 - protein, 566 aa, Artificial Sequence; identical to SEQ ID NO: 9883
  hemagglutinin__InfluenzaA__AGW01905

SEQ ID NO: 10564 - protein, 566 aa, Artificial Sequence; identical to SEQ ID NO: 9994
  hemagglutinin__InfluenzaA__AGW01917

SEQ ID NO: 10565 - protein, 566 aa, Artificial Sequence; identical to SEQ ID NO: 9858
  hemagglutinin__InfluenzaA__AGW01929

SEQ ID NO: 10566 - protein, 566 aa, Artificial Sequence; identical to SEQ ID NO: 9994
  hemagglutinin__InfluenzaA__AGW01941

SEQ ID NO: 10567 - protein, 566 aa, Artificial Sequence; identical to SEQ ID NO: 9858
  hemagglutinin__InfluenzaA__AGW01953

SEQ ID NO: 10568 - protein, 566 aa, Artificial Sequence
  hemagglutinin__InfluenzaA__AGW01965
MKTIIALSYILCLVFAQELPGNDDSMATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNDCIGSIRNGTYDHNVYRDEALNNRFQIKGIELKSGYKDWILWISFAISCFLLCVALLGFIMWACQKGNIRCNICI

SEQ ID NO: 10569 - protein, 566 aa, Artificial Sequence; identical to SEQ ID NO: 9994
  hemagglutinin__InfluenzaA__AGW01977

SEQ ID NO: 10570 - protein, 566 aa, Artificial Sequence; identical to SEQ ID NO: 9994
  hemagglutinin__InfluenzaA__AGW01989

SEQ ID NO: 10571 - protein, 566 aa, Artificial Sequence; identical to SEQ ID NO: 9994
  hemagglutinin__InfluenzaA__AGW02001

SEQ ID NO: 10572 - protein, 566 aa, Artificial Sequence; identical to SEQ ID NO: 9994
  hemagglutinin__InfluenzaA__AGW02013

SEQ ID NO: 10573 - protein, 566 aa, Artificial Sequence; identical to SEQ ID NO: 9858
  hemagglutinin__InfluenzaA__AGW02025

SEQ ID NO: 10574 - protein, 566 aa, Artificial Sequence; identical to SEQ ID NO: 9994
  hemagglutinin__InfluenzaA__AGW02037

SEQ ID NO: 10575 - protein, 566 aa, Artificial Sequence; identical to SEQ ID NO: 9994
  hemagglutinin__InfluenzaA__AGW02061

SEQ ID NO: 10576 - protein, 566 aa, Artificial Sequence; identical to SEQ ID NO: 9994
  hemagglutinin__InfluenzaA__AGW02073

SEQ ID NO: 10577 - protein, 566 aa, Artificial Sequence; identical to SEQ ID NO: 9994
  hemagglutinin__InfluenzaA__AGW02085

SEQ ID NO: 10578 - protein, 566 aa, Artificial Sequence; identical to SEQ ID NO: 9883
  hemagglutinin__InfluenzaA__AGW02097

SEQ ID NO: 10579 - protein, 566 aa, Artificial Sequence; identical to SEQ ID NO: 9858
  hemagglutinin__InfluenzaA__AGW02109

SEQ ID NO: 10580 - protein, 566 aa, Artificial Sequence; identical to SEQ ID NO: 9994
  hemagglutinin__InfluenzaA__AGW02133

SEQ ID NO: 10581 - protein, 566 aa, Artificial Sequence; identical to SEQ ID NO: 9994
  hemagglutinin__InfluenzaA__AGW02157

SEQ ID NO: 10582 - protein, 566 aa, Artificial Sequence; identical to SEQ ID NO: 9858
  hemagglutinin__InfluenzaA__AGW02169

SEQ ID NO: 10583 - protein, 566 aa, Artificial Sequence; identical to SEQ ID NO: 9994
  hemagglutinin__InfluenzaA__AGW02181

SEQ ID NO: 10584 - protein, 566 aa, Artificial Sequence; identical to SEQ ID NO: 9868
  hemagglutinin__InfluenzaA__AGW02193

SEQ ID NO: 10585 - protein, 566 aa, Artificial Sequence; identical to SEQ ID NO: 9835
  hemagglutinin__InfluenzaA__AGW04171

SEQ ID NO: 10586 - protein, 568 aa, Artificial Sequence
  hemagglutinin__InfluenzaA__AGW27061
MEKIVLLFAIVNLVKSDHICIGYHANNSTEQVDTIMEKNVTVTHAQDILEKTHNGKLCDLNGVKPLILKDCSVAGWLLGNPMCDEFIDVPEWSYIVEKANPANDLCYPGNFNDYEELKHLLSRINHFEKIRIIPKDSWPDHEASLGVSAACSYQGNSSFFRNVVWLLKKNDAYPIIKKSYNNTNKEDLLVLWGIHHPNDEAEQIRLYQNPTTYVSTGTSTLNQRLVPRIATRSKVNGQSGRIDFFWTILKPNDAINFESNGNFIAPEYAYKIVKKGDSTIMRSEVEYGNCSTRCQTPMGAINSSMPFHNIHPLTIGECPKYVKSNKLVLATGLRNSPQIERRRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLVLSIMVAGLSLWMCSNGSLQCRMCI

SEQ ID NO: 10587 - protein, 565 aa, Artificial Sequence
  hemagglutinin__InfluenzaA__AGY14471
MKVKLLILLCTFTATYADTICIGYHANNSTDTVDTILEKNVTVTHSVNLLEDSHNGKLCLLKGIAPLQLGNCSVAGWILGNPECGLLIPKESWSYIVETPNPENGTCYPGYFDDYEELREQLSSVSSFERFEIFPKESSWPNHTVTGVSASCSHNGKSSFYRNLLWLTGKNGLYPNLSKSYANNKEKEVLILWGVHHPSNIGNQRTLYHTENTYVSVVSSHYSRRFTPEITKRPKVRDQEGRINYYWTLLEPGDTIIFEANGNLIAPWYAFALSKGFGSGIITSNAPMDECDAKCQTPQGAINSNLPFQNVHPVTIGECPKYVRSTKLRMVTGLRNIPSIQSRGLFGAIAGFIEGGWTGMVDGWYGYHHQNEQGSGYAADQESTQNAINGITNKVNSVIEKMNTQFTVVGKEFNKLERRMENLNKKVDDGFLDIWTYNAELLVLLENERTLDFHDSNVMNLYEKVKGQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 10588 - protein, 565 aa, Artificial Sequence; identical to SEQ ID NO: 10587
  hemagglutinin__InfluenzaA__AGY14477

SEQ ID NO: 10589 - protein, 566 aa, Artificial Sequence
  hemagglutinin__InfluenzaA__AHC57459
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRIRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10590 - protein, 566 aa, Artificial Sequence; identical to SEQ ID NO: 6982
  hemagglutinin__InfluenzaA__AHC57465

SEQ ID NO: 10591 - protein, 566 aa, Artificial Sequence; identical to SEQ ID NO: 6855
  hemagglutinin__InfluenzaA__AHC57487

SEQ ID NO: 10592 - protein, 566 aa, Artificial Sequence; identical to SEQ ID NO: 7782
  hemagglutinin__InfluenzaA__AHC57499

SEQ ID NO: 10593 - protein, 566 aa, Artificial Sequence; identical to SEQ ID NO: 7782
  hemagglutinin__InfluenzaA__AHC57511

SEQ ID NO: 10594 - protein, 566 aa, Artificial Sequence; identical to SEQ ID NO: 7782
  hemagglutinin__InfluenzaA__AHC57523

SEQ ID NO: 10595 - protein, 566 aa, Artificial Sequence; identical to SEQ ID NO: 6982
  hemagglutinin__InfluenzaA__AHC57675

SEQ ID NO: 10596 - protein, 566 aa, Artificial Sequence; identical to SEQ ID NO: 6982
  hemagglutinin__InfluenzaA__AHC57827

SEQ ID NO: 10597 - protein, 566 aa, Artificial Sequence; identical to SEQ ID NO: 6855
  hemagglutinin__InfluenzaA__AHC57956

SEQ ID NO: 10598 - protein, 566 aa, Artificial Sequence
  hemagglutinin__InfluenzaA__AHC57981
MKTIIALSYILCLVFAQKIPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLIASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGNLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10599 - protein, 566 aa, Artificial Sequence; identical to SEQ ID NO: 7782
  hemagglutinin__InfluenzaA__AHC57993

SEQ ID NO: 10600 - protein, 566 aa, Artificial Sequence; identical to SEQ ID NO: 9074
  hemagglutinin__InfluenzaA__AHC58005

SEQ ID NO: 10601 - protein, 566 aa, Artificial Sequence
  hemagglutinin__InfluenzaA__AHC58017
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIVSIRNGTYDHDVYRDEALNNRFQIKGVELKSGYKDWILWISFAISCFLLCVALLGFIMWACQKGNIRCNICI

SEQ ID NO: 10602 - protein, 566 aa, Artificial Sequence
  hemagglutinin__InfluenzaA__AHC58029
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTQLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10603 - protein, 566 aa, Artificial Sequence
  hemagglutinin__InfluenzaA__AHC58050
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTRRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10604 - protein, 566 aa, Artificial Sequence; identical to SEQ ID NO: 7782
  hemagglutinin__InfluenzaA__AHC58074

SEQ ID NO: 10605 - protein, 566 aa, Artificial Sequence; identical to SEQ ID NO: 7782
  hemagglutinin__InfluenzaA__AHC58098

SEQ ID NO: 10606 - protein, 566 aa, Artificial Sequence; identical to SEQ ID NO: 7782
  hemagglutinin__InfluenzaA__AHC58110

SEQ ID NO: 10607 - protein, 566 aa, Artificial Sequence; identical to SEQ ID NO: 7782
  hemagglutinin__InfluenzaA__AHC58126

SEQ ID NO: 10608 - protein, 566 aa, Artificial Sequence; identical to SEQ ID NO: 7782
  hemagglutinin__InfluenzaA__AHC58138

SEQ ID NO: 10609 - protein, 566 aa, Artificial Sequence; identical to SEQ ID NO: 7782
  hemagglutinin__InfluenzaA__AHC58162

SEQ ID NO: 10610 - protein, 566 aa, Artificial Sequence; identical to SEQ ID NO: 9074
  hemagglutinin__InfluenzaA__AHC58186

SEQ ID NO: 10611 - protein, 566 aa, Artificial Sequence
  hemagglutinin__InfluenzaA__AHC58198
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQNLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWDCQKGNIRCNICI

SEQ ID NO: 10612 - protein, 566 aa, Artificial Sequence
  hemagglutinin__InfluenzaA__AHC58210
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWAGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10613 - protein, 566 aa, Artificial Sequence; identical to SEQ ID NO: 6982
  hemagglutinin__InfluenzaA__AHC58234

SEQ ID NO: 10614 - protein, 566 aa, Artificial Sequence; identical to SEQ ID NO: 7782
  hemagglutinin__InfluenzaA__AHC58246

SEQ ID NO: 10615 - protein, 566 aa, Artificial Sequence; identical to SEQ ID NO: 6982
  hemagglutinin__InfluenzaA__AHC58258

SEQ ID NO: 10616 - protein, 566 aa, Artificial Sequence; identical to SEQ ID NO: 6855
  hemagglutinin__InfluenzaA__AHC58270

SEQ ID NO: 10617 - protein, 566 aa, Artificial Sequence
  hemagglutinin__InfluenzaA__AHC58372
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVTPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10618 - protein, 566 aa, Artificial Sequence
  hemagglutinin__InfluenzaA__AHC58396
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10619 - protein, 566 aa, Artificial Sequence; identical to SEQ ID NO: 7782
  hemagglutinin__InfluenzaA__AHC58408

SEQ ID NO: 10620 - protein, 566 aa, Artificial Sequence; identical to SEQ ID NO: 9074
  hemagglutinin__InfluenzaA__AHC58420

SEQ ID NO: 10621 - protein, 566 aa, Artificial Sequence; identical to SEQ ID NO: 9074
  hemagglutinin__InfluenzaA__AHC58432

SEQ ID NO: 10622 - protein, 566 aa, Artificial Sequence; identical to SEQ ID NO: 6982
  hemagglutinin__InfluenzaA__AHC58444

SEQ ID NO: 10623 - protein, 566 aa, Artificial Sequence; identical to SEQ ID NO: 10618
  hemagglutinin__InfluenzaA__AHC58456

SEQ ID NO: 10624 - protein, 566 aa, Artificial Sequence
  hemagglutinin__InfluenzaA__AHC58468
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPQAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNAQGSGYAADLKSTQNAIDKITNKVNSVIEKMNTQFTAVGKEFNHLERRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 10625 - protein, 566 aa, Artificial Sequence
  hemagglutinin__InfluenzaA__AHC58479
MKTIIALSYILCLVFAQKLPGNDNSTATLCLGHHAVPNGTIVKTITNDQIEVTNATELVQNSSTGEICDSPHQIIDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAINQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFKIKGVELKSGYKDWILWISFAISCFLLCVALLGFIMWACQKGNIRCNICI

SEQ ID NO: 10626 - protein, 566 aa, Artificial Sequence; identical to SEQ ID NO: 10618
  hemagglutinin__InfluenzaA__AHC58491

SEQ ID NO: 10627 - protein, 566 aa, Artificial Sequence; identical to SEQ ID NO: 6982
  hemagglutinin__InfluenzaA__AHC58515

SEQ ID NO: 10628 - protein, 566 aa, Artificial Sequence; identical to SEQ ID NO: 7782
  hemagglutinin__InfluenzaA__AHC58527

SEQ ID NO: 10629 - protein, 566 aa, Artificial Sequence
  hemagglutinin__InfluenzaA__AHC58563
MKTIIALSYILCLVFAQKLPGNDNSTATLCLGHHAVPNGTIVKTITNDQIEVTNATELVQNSSTGEICDSPHQIIDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10630 - protein, 566 aa, Artificial Sequence; identical to SEQ ID NO: 7782
  hemagglutinin__InfluenzaA__AHC58575

SEQ ID NO: 10631 - protein, 566 aa, Artificial Sequence; identical to SEQ ID NO: 6855
  hemagglutinin__InfluenzaA__AHC58587

SEQ ID NO: 10632 - protein, 566 aa, Artificial Sequence; identical to SEQ ID NO: 6982
  hemagglutinin__InfluenzaA__AHC58599

SEQ ID NO: 10633 - protein, 566 aa, Artificial Sequence; identical to SEQ ID NO: 7782
  hemagglutinin__InfluenzaA__AHC58611

SEQ ID NO: 10634 - protein, 566 aa, Artificial Sequence; identical to SEQ ID NO: 7782
  hemagglutinin__InfluenzaA__AHC58623

SEQ ID NO: 10635 - protein, 566 aa, Artificial Sequence; identical to SEQ ID NO: 7782
  hemagglutinin__InfluenzaA__AHC58647

SEQ ID NO: 10636 - protein, 566 aa, Artificial Sequence; identical to SEQ ID NO: 6982
  hemagglutinin__InfluenzaA__AHC58659

SEQ ID NO: 10637 - protein, 566 aa, Artificial Sequence; identical to SEQ ID NO: 6855
  hemagglutinin__InfluenzaA__AHC58671

SEQ ID NO: 10638 - protein, 566 aa, Artificial Sequence; identical to SEQ ID NO: 9074
  hemagglutinin__InfluenzaA__AHC58683

SEQ ID NO: 10639 - protein, 566 aa, Artificial Sequence; identical to SEQ ID NO: 6855
  hemagglutinin__InfluenzaA__AHC58695

SEQ ID NO: 10640 - protein, 566 aa, Artificial Sequence; identical to SEQ ID NO: 9074
  hemagglutinin__InfluenzaA__AHC58707

SEQ ID NO: 10641 - protein, 566 aa, Artificial Sequence; identical to SEQ ID NO: 9074
  hemagglutinin__InfluenzaA__AHC58719

SEQ ID NO: 10642 - protein, 566 aa, Artificial Sequence; identical to SEQ ID NO: 10618
  hemagglutinin__InfluenzaA__AHC58731

SEQ ID NO: 10643 - protein, 566 aa, Artificial Sequence
  hemagglutinin__InfluenzaA__AHC58743
MKTIIAWSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10644 - protein, 566 aa, Artificial Sequence; identical to SEQ ID NO: 10618
  hemagglutinin__InfluenzaA__AHC58755

SEQ ID NO: 10645 - protein, 566 aa, Artificial Sequence; identical to SEQ ID NO: 6855
  hemagglutinin__InfluenzaA__AHC58779

SEQ ID NO: 10646 - protein, 566 aa, Artificial Sequence; identical to SEQ ID NO: 10617
  hemagglutinin__InfluenzaA__AHC58791

SEQ ID NO: 10647 - protein, 566 aa, Artificial Sequence
  hemagglutinin__InfluenzaA__AHC58803
MKTIIALSYILCLVFAQKLPGNDNSTATLCLGHHAVPNGTIVKTITNDQIEVTNATELVQNSSTGEICDSPHQIIDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFKIKGVELKSGYKDWILWISFAISCFLLCVALLGFIMWACQKGNIRCNICI

SEQ ID NO: 10648 - protein, 566 aa, Artificial Sequence
  hemagglutinin__InfluenzaA__AHC58815
MKTIIALSYILCLVFAQKLPGNDNSTATLCLGHHAVPNGTIVKTITNDQIEVTNATELVQSSSTGEICNSPHQILDGGNCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10649 - protein, 566 aa, Artificial Sequence; identical to SEQ ID NO: 6855
  hemagglutinin__InfluenzaA__AHC58827

SEQ ID NO: 10650 - protein, 566 aa, Artificial Sequence; identical to SEQ ID NO: 7782
  hemagglutinin__InfluenzaA__AHC58839

SEQ ID NO: 10651 - protein, 566 aa, Artificial Sequence
  hemagglutinin__InfluenzaA__AHC58863
MKTIIALSYILCLVFAQKLPGNDNSTATLCLGHHAVSNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10652 - protein, 566 aa, Artificial Sequence; identical to SEQ ID NO: 6855
  hemagglutinin__InfluenzaA__AHC58875

SEQ ID NO: 10653 - protein, 566 aa, Artificial Sequence; identical to SEQ ID NO: 7782
  hemagglutinin__InfluenzaA__AHC58887

SEQ ID NO: 10654 - protein, 566 aa, Artificial Sequence; identical to SEQ ID NO: 10618
  hemagglutinin__InfluenzaA__AHC58899

SEQ ID NO: 10655 - protein, 566 aa, Artificial Sequence; identical to SEQ ID NO: 7782
  hemagglutinin__InfluenzaA__AHC58981

SEQ ID NO: 10656 - protein, 566 aa, Artificial Sequence; identical to SEQ ID NO: 7782
  hemagglutinin__InfluenzaA__AHC58993

SEQ ID NO: 10657 - protein, 566 aa, Artificial Sequence; identical to SEQ ID NO: 7782
  hemagglutinin__InfluenzaA__AHC59005

SEQ ID NO: 10658 - protein, 566 aa, Artificial Sequence
  hemagglutinin__InfluenzaA__AHC59017
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMSKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10659 - protein, 566 aa, Artificial Sequence; identical to SEQ ID NO: 10618
  hemagglutinin__InfluenzaA__AHC59029

SEQ ID NO: 10660 - protein, 566 aa, Artificial Sequence; identical to SEQ ID NO: 6982
  hemagglutinin__InfluenzaA__AHC59041

SEQ ID NO: 10661 - protein, 566 aa, Artificial Sequence
  hemagglutinin__InfluenzaA__AHC59053
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIQSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWTCQKGNIRCNICI

SEQ ID NO: 10662 - protein, 566 aa, Artificial Sequence
  hemagglutinin__InfluenzaA__AHC59077
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 10663 - protein, 566 aa, Artificial Sequence; identical to SEQ ID NO: 9074
  hemagglutinin__InfluenzaA__AHC59089

SEQ ID NO: 10664 - protein, 566 aa, Artificial Sequence; identical to SEQ ID NO: 7782
  hemagglutinin__InfluenzaA__AHC59101

SEQ ID NO: 10665 - protein, 566 aa, Artificial Sequence; identical to SEQ ID NO: 6982
  hemagglutinin__InfluenzaA__AHC59113

SEQ ID NO: 10666 - protein, 566 aa, Artificial Sequence; identical to SEQ ID NO: 7782
  hemagglutinin__InfluenzaA__AHC59125

SEQ ID NO: 10667 - protein, 566 aa, Artificial Sequence
  hemagglutinin__InfluenzaA__AHC59137
MKTIIALSYILCLVFAQKIPGNDNSTATLCLGHHAVSNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10668 - protein, 566 aa, Artificial Sequence; identical to SEQ ID NO: 6982
  hemagglutinin__InfluenzaA__AHC59149

SEQ ID NO: 10669 - protein, 566 aa, Artificial Sequence
  hemagglutinin__InfluenzaA__AHC59185
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10670 - protein, 566 aa, Artificial Sequence; identical to SEQ ID NO: 6855
  hemagglutinin__InfluenzaA__AHC59197

SEQ ID NO: 10671 - protein, 566 aa, Artificial Sequence
  hemagglutinin__InfluenzaA__AHC59209
MKTIIALSYILCLVFAQEIPGNDNSTATLCLGHHAVPNGTIVKTITNDQIEVTNATELVQSSSTGEICNSPHQILDGENCTLIDALLGDPQCDDFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGECNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHAVYRDEALNNRFQIKGVELKSGYKDWILWISFAISCFLLCVALLGFIMWACQKGNIRCNICI

SEQ ID NO: 10672 - protein, 566 aa, Artificial Sequence; identical to SEQ ID NO: 6982
  hemagglutinin__InfluenzaA__AHC59221

SEQ ID NO: 10673 - protein, 566 aa, Artificial Sequence; identical to SEQ ID NO: 10651
  hemagglutinin__InfluenzaA__AHC59245

SEQ ID NO: 10674 - protein, 566 aa, Artificial Sequence; identical to SEQ ID NO: 10618
  hemagglutinin__InfluenzaA__AHC59257

SEQ ID NO: 10675 - protein, 566 aa, Artificial Sequence; identical to SEQ ID NO: 7782
  hemagglutinin__InfluenzaA__AHC59269

SEQ ID NO: 10676 - protein, 566 aa, Artificial Sequence; identical to SEQ ID NO: 10618
  hemagglutinin__InfluenzaA__AHC59281

SEQ ID NO: 10677 - protein, 566 aa, Artificial Sequence; identical to SEQ ID NO: 6982
  hemagglutinin__InfluenzaA__AHC59293

SEQ ID NO: 10678 - protein, 566 aa, Artificial Sequence
  hemagglutinin__InfluenzaA__AHC59305
MKTIIALSYILCLVFAQKLPGNDNSTATLCLGHHAVPNGTIVKTITNDQIEVTNATELVQSSSTGEICSSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10679 - protein, 566 aa, Artificial Sequence
  hemagglutinin__InfluenzaA__AHC59329
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTEKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10680 - protein, 566 aa, Artificial Sequence; identical to SEQ ID NO: 9074
  hemagglutinin__InfluenzaA__AHC59341

SEQ ID NO: 10681 - protein, 566 aa, Artificial Sequence; identical to SEQ ID NO: 10618
  hemagglutinin__InfluenzaA__AHC59365

SEQ ID NO: 10682 - protein, 566 aa, Artificial Sequence
  hemagglutinin__InfluenzaA__AHC59377
MKTIIALSYILCLVFAQKLPGNDNSTATLCLGHHAVPNGTVVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQNLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10683 - protein, 566 aa, Artificial Sequence; identical to SEQ ID NO: 6982
  hemagglutinin__InfluenzaA__AHC59413

SEQ ID NO: 10684 - protein, 566 aa, Artificial Sequence; identical to SEQ ID NO: 7782
  hemagglutinin__InfluenzaA__AHC59425

SEQ ID NO: 10685 - protein, 566 aa, Artificial Sequence; identical to SEQ ID NO: 9074
  hemagglutinin__InfluenzaA__AHC59437

SEQ ID NO: 10686 - protein, 566 aa, Artificial Sequence
  hemagglutinin__InfluenzaA__AHC59449
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGRTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10687 - protein, 566 aa, Artificial Sequence; identical to SEQ ID NO: 6855
  hemagglutinin__InfluenzaA__AHC59461

SEQ ID NO: 10688 - protein, 566 aa, Artificial Sequence; identical to SEQ ID NO: 10679
  hemagglutinin__InfluenzaA__AHC59473

SEQ ID NO: 10689 - protein, 566 aa, Artificial Sequence; identical to SEQ ID NO: 6982
  hemagglutinin__InfluenzaA__AHC59485

SEQ ID NO: 10690 - protein, 566 aa, Artificial Sequence; identical to SEQ ID NO: 6982
  hemagglutinin__InfluenzaA__AHC59497

SEQ ID NO: 10691 - protein, 566 aa, Artificial Sequence; identical to SEQ ID NO: 6855
  hemagglutinin__InfluenzaA__AHC59509

SEQ ID NO: 10692 - protein, 566 aa, Artificial Sequence; identical to SEQ ID NO: 6855
  hemagglutinin__InfluenzaA__AHC59521

SEQ ID NO: 10693 - protein, 566 aa, Artificial Sequence
  hemagglutinin__InfluenzaA__AHC59533
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFKNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10694 - protein, 566 aa, Artificial Sequence; identical to SEQ ID NO: 6982
  hemagglutinin__InfluenzaA__AHC59545

SEQ ID NO: 10695 - protein, 566 aa, Artificial Sequence; identical to SEQ ID NO: 10618
  hemagglutinin__InfluenzaA__AHC59557

SEQ ID NO: 10696 - protein, 566 aa, Artificial Sequence
  hemagglutinin__InfluenzaA__AHC59569
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10697 - protein, 566 aa, Artificial Sequence; identical to SEQ ID NO: 6982
  hemagglutinin__InfluenzaA__AHC59581

SEQ ID NO: 10698 - protein, 566 aa, Artificial Sequence; identical to SEQ ID NO: 6855
  hemagglutinin__InfluenzaA__AHC59593

SEQ ID NO: 10699 - protein, 566 aa, Artificial Sequence; identical to SEQ ID NO: 9074
  hemagglutinin__InfluenzaA__AHC59605

SEQ ID NO: 10700 - protein, 566 aa, Artificial Sequence; identical to SEQ ID NO: 6982
  hemagglutinin__InfluenzaA__AHC59617

SEQ ID NO: 10701 - protein, 566 aa, Artificial Sequence; identical to SEQ ID NO: 6982
  hemagglutinin__InfluenzaA__AHC59629

SEQ ID NO: 10702 - protein, 566 aa, Artificial Sequence; identical to SEQ ID NO: 10618
  hemagglutinin__InfluenzaA__AHC59641

SEQ ID NO: 10703 - protein, 566 aa, Artificial Sequence
  hemagglutinin__InfluenzaA__AHC59653
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTQRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10704 - protein, 566 aa, Artificial Sequence; identical to SEQ ID NO: 6855
  hemagglutinin__InfluenzaA__AHC59665

SEQ ID NO: 10705 - protein, 566 aa, Artificial Sequence; identical to SEQ ID NO: 6982
  hemagglutinin__InfluenzaA__AHC59677

SEQ ID NO: 10706 - protein, 566 aa, Artificial Sequence; identical to SEQ ID NO: 10703
  hemagglutinin__InfluenzaA__AHC59689

SEQ ID NO: 10707 - protein, 566 aa, Artificial Sequence; identical to SEQ ID NO: 10618
  hemagglutinin__InfluenzaA__AHC59701

SEQ ID NO: 10708 - protein, 566 aa, Artificial Sequence; identical to SEQ ID NO: 6855
  hemagglutinin__InfluenzaA__AHC59713

SEQ ID NO: 10709 - protein, 566 aa, Artificial Sequence; identical to SEQ ID NO: 10629
  hemagglutinin__InfluenzaA__AHC59737

SEQ ID NO: 10710 - protein, 566 aa, Artificial Sequence; identical to SEQ ID NO: 6855
  hemagglutinin__InfluenzaA__AHC59749

SEQ ID NO: 10711 - protein, 566 aa, Artificial Sequence; identical to SEQ ID NO: 6982
  hemagglutinin__InfluenzaA__AHC59761

SEQ ID NO: 10712 - protein, 566 aa, Artificial Sequence; identical to SEQ ID NO: 6982
  hemagglutinin__InfluenzaA__AHC59773

SEQ ID NO: 10713 - protein, 566 aa, Artificial Sequence; identical to SEQ ID NO: 7782
  hemagglutinin__InfluenzaA__AHC59785

SEQ ID NO: 10714 - protein, 566 aa, Artificial Sequence; identical to SEQ ID NO: 6982
  hemagglutinin__InfluenzaA__AHC59797

SEQ ID NO: 10715 - protein, 566 aa, Artificial Sequence; identical to SEQ ID NO: 9074
  hemagglutinin__InfluenzaA__AHC59809

SEQ ID NO: 10716 - protein, 566 aa, Artificial Sequence
  hemagglutinin__InfluenzaA__AHC59821
MKTIIALSYILCLVFAQKLPGNDNSTATLCLGHHAVPNGTIVKTITNDQIEVTNATELVQNSSTGEICDSPHQILDGENCTLIDALLGDPQCDGLQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLVEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10717 - protein, 566 aa, Artificial Sequence; identical to SEQ ID NO: 10618
  hemagglutinin__InfluenzaA__AHC59833

SEQ ID NO: 10718 - protein, 566 aa, Artificial Sequence; identical to SEQ ID NO: 10617
  hemagglutinin__InfluenzaA__AHC59845

SEQ ID NO: 10719 - protein, 566 aa, Artificial Sequence; identical to SEQ ID NO: 7782
  hemagglutinin__InfluenzaA__AHC59857

SEQ ID NO: 10720 - protein, 566 aa, Artificial Sequence; identical to SEQ ID NO: 6982
  hemagglutinin__InfluenzaA__AHC59869

SEQ ID NO: 10721 - protein, 566 aa, Artificial Sequence; identical to SEQ ID NO: 6982
  hemagglutinin__InfluenzaA__AHC59881

SEQ ID NO: 10722 - protein, 566 aa, Artificial Sequence; identical to SEQ ID NO: 6855
  hemagglutinin__InfluenzaA__AHC59892

SEQ ID NO: 10723 - protein, 566 aa, Artificial Sequence
  hemagglutinin__InfluenzaA__AHC59904
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10724 - protein, 566 aa, Artificial Sequence
  hemagglutinin__InfluenzaA__AHC59915
MKTVIALSYILCLAFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10725 - protein, 566 aa, Artificial Sequence; identical to SEQ ID NO: 6982
  hemagglutinin__InfluenzaA__AHC59939

SEQ ID NO: 10726 - protein, 566 aa, Artificial Sequence
  hemagglutinin__InfluenzaA__AHC59963
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYIKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10727 - protein, 566 aa, Artificial Sequence; identical to SEQ ID NO: 6855
  hemagglutinin__InfluenzaA__AHC59987

SEQ ID NO: 10728 - protein, 566 aa, Artificial Sequence; identical to SEQ ID NO: 6855
  hemagglutinin__InfluenzaA__AHC59999

SEQ ID NO: 10729 - protein, 566 aa, Artificial Sequence; identical to SEQ ID NO: 6982
  hemagglutinin__InfluenzaA__AHC60011

SEQ ID NO: 10730 - protein, 566 aa, Artificial Sequence; identical to SEQ ID NO: 6855
  hemagglutinin__InfluenzaA__AHC60023

SEQ ID NO: 10731 - protein, 566 aa, Artificial Sequence; identical to SEQ ID NO: 7782
  hemagglutinin__InfluenzaA__AHC60035

SEQ ID NO: 10732 - protein, 566 aa, Artificial Sequence; identical to SEQ ID NO: 7782
  hemagglutinin__InfluenzaA__AHC60047

SEQ ID NO: 10733 - protein, 566 aa, Artificial Sequence
  hemagglutinin__InfluenzaA__AHC60059
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10734 - protein, 566 aa, Artificial Sequence; identical to SEQ ID NO: 9074
  hemagglutinin__InfluenzaA__AHC60071

SEQ ID NO: 10735 - protein, 566 aa, Artificial Sequence; identical to SEQ ID NO: 10618
  hemagglutinin__InfluenzaA__AHC60083

SEQ ID NO: 10736 - protein, 566 aa, Artificial Sequence; identical to SEQ ID NO: 7782
  hemagglutinin__InfluenzaA__AHC60095

SEQ ID NO: 10737 - protein, 566 aa, Artificial Sequence
  hemagglutinin__InfluenzaA__AHC60107
MKTIIALSYILCLVFAQKLPGNDNSTATLCLGHHAVPNGTIVKTITNDQIEVTNATELVQNSSTGEICDSPHQIIDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFKIKGVELKSGYKDWILWISFAISCFLLCVALLGFIMWACQKGNIRCNICI

SEQ ID NO: 10738 - protein, 566 aa, Artificial Sequence; identical to SEQ ID NO: 6982
  hemagglutinin__InfluenzaA__AHC60119

SEQ ID NO: 10739 - protein, 566 aa, Artificial Sequence; identical to SEQ ID NO: 6982
  hemagglutinin__InfluenzaA__AHC60131

SEQ ID NO: 10740 - protein, 566 aa, Artificial Sequence; identical to SEQ ID NO: 10648
  hemagglutinin__InfluenzaA__AHC60143

SEQ ID NO: 10741 - protein, 566 aa, Artificial Sequence
  hemagglutinin__InfluenzaA__AHC60155
MKTVIALSYILCLAFAQKLPGNDNSTATLCLGHHAVPNGTIVKTITNDQIEVTNATELVQSSPTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10742 - protein, 566 aa, Artificial Sequence; identical to SEQ ID NO: 6855
  hemagglutinin__InfluenzaA__AHC60167

SEQ ID NO: 10743 - protein, 566 aa, Artificial Sequence; identical to SEQ ID NO: 7782
  hemagglutinin__InfluenzaA__AHC60179

SEQ ID NO: 10744 - protein, 566 aa, Artificial Sequence; identical to SEQ ID NO: 10693
  hemagglutinin__InfluenzaA__AHC60191

SEQ ID NO: 10745 - protein, 566 aa, Artificial Sequence; identical to SEQ ID NO: 10693
  hemagglutinin__InfluenzaA__AHC60203

SEQ ID NO: 10746 - protein, 566 aa, Artificial Sequence; identical to SEQ ID NO: 9074
  hemagglutinin__InfluenzaA__AHC60215

SEQ ID NO: 10747 - protein, 566 aa, Artificial Sequence; identical to SEQ ID NO: 7782
  hemagglutinin__InfluenzaA__AHC60239

SEQ ID NO: 10748 - protein, 566 aa, Artificial Sequence; identical to SEQ ID NO: 7782
  hemagglutinin__InfluenzaA__AHC60251

SEQ ID NO: 10749 - protein, 566 aa, Artificial Sequence
  hemagglutinin__InfluenzaA__AHC60263
MKTIIALSYILCLVFAQKLPGNENSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10750 - protein, 566 aa, Artificial Sequence; identical to SEQ ID NO: 6855
  hemagglutinin__InfluenzaA__AHC60275

SEQ ID NO: 10751 - protein, 566 aa, Artificial Sequence; identical to SEQ ID NO: 10737
  hemagglutinin__InfluenzaA__AHC60287

SEQ ID NO: 10752 - protein, 566 aa, Artificial Sequence; identical to SEQ ID NO: 10618
  hemagglutinin__InfluenzaA__AHC60299

SEQ ID NO: 10753 - protein, 566 aa, Artificial Sequence
  hemagglutinin__InfluenzaA__AHC60311
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFDNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10754 - protein, 566 aa, Artificial Sequence; identical to SEQ ID NO: 7782
  hemagglutinin__InfluenzaA__AHC60323

SEQ ID NO: 10755 - protein, 566 aa, Artificial Sequence; identical to SEQ ID NO: 9074
  hemagglutinin__InfluenzaA__AHC60335

SEQ ID NO: 10756 - protein, 566 aa, Artificial Sequence; identical to SEQ ID NO: 6855
  hemagglutinin__InfluenzaA__AHC60347

SEQ ID NO: 10757 - protein, 566 aa, Artificial Sequence; identical to SEQ ID NO: 6982
  hemagglutinin__InfluenzaA__AHC60359

SEQ ID NO: 10758 - protein, 566 aa, Artificial Sequence; identical to SEQ ID NO: 10679
  hemagglutinin__InfluenzaA__AHC60371

SEQ ID NO: 10759 - protein, 566 aa, Artificial Sequence; identical to SEQ ID NO: 6855
  hemagglutinin__InfluenzaA__AHC60383

SEQ ID NO: 10760 - protein, 566 aa, Artificial Sequence; identical to SEQ ID NO: 6982
  hemagglutinin__InfluenzaA__AHC60395

SEQ ID NO: 10761 - protein, 566 aa, Artificial Sequence; identical to SEQ ID NO: 10693
  hemagglutinin__InfluenzaA__AHC60407

SEQ ID NO: 10762 - protein, 566 aa, Artificial Sequence; identical to SEQ ID NO: 6855
  hemagglutinin__InfluenzaA__AHC60419

SEQ ID NO: 10763 - protein, 566 aa, Artificial Sequence; identical to SEQ ID NO: 6982
  hemagglutinin__InfluenzaA__AHC60431

SEQ ID NO: 10764 - protein, 566 aa, Artificial Sequence; identical to SEQ ID NO: 6855
  hemagglutinin__InfluenzaA__AHC60455

SEQ ID NO: 10765 - protein, 566 aa, Artificial Sequence; identical to SEQ ID NO: 6855
  hemagglutinin__InfluenzaA__AHC60467

SEQ ID NO: 10766 - protein, 566 aa, Artificial Sequence; identical to SEQ ID NO: 10617
  hemagglutinin__InfluenzaA__AHC60479

SEQ ID NO: 10767 - protein, 566 aa, Artificial Sequence; identical to SEQ ID NO: 7782
  hemagglutinin__InfluenzaA__AHC60491

SEQ ID NO: 10768 - protein, 566 aa, Artificial Sequence
  hemagglutinin__InfluenzaA__AHC60503
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 10769 - protein, 566 aa, Artificial Sequence; identical to SEQ ID NO: 6982
  hemagglutinin__InfluenzaA__AHC60515

SEQ ID NO: 10770 - protein, 566 aa, Artificial Sequence; identical to SEQ ID NO: 7782
  hemagglutinin__InfluenzaA__AHC60527

SEQ ID NO: 10771 - protein, 566 aa, Artificial Sequence; identical to SEQ ID NO: 6982
  hemagglutinin__InfluenzaA__AHC60539

SEQ ID NO: 10772 - protein, 566 aa, Artificial Sequence; identical to SEQ ID NO: 10629
  hemagglutinin__InfluenzaA__AHC60551

SEQ ID NO: 10773 - protein, 566 aa, Artificial Sequence; identical to SEQ ID NO: 9074
  hemagglutinin__InfluenzaA__AHC60563

SEQ ID NO: 10774 - protein, 566 aa, Artificial Sequence; identical to SEQ ID NO: 9074
  hemagglutinin__InfluenzaA__AHC60575

SEQ ID NO: 10775 - protein, 566 aa, Artificial Sequence
  hemagglutinin__InfluenzaA__AHC60587
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQNLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10776 - protein, 566 aa, Artificial Sequence; identical to SEQ ID NO: 9074
  hemagglutinin__InfluenzaA__AHC60599

SEQ ID NO: 10777 - protein, 566 aa, Artificial Sequence; identical to SEQ ID NO: 6855
  hemagglutinin__InfluenzaA__AHC60611

SEQ ID NO: 10778 - protein, 566 aa, Artificial Sequence
  hemagglutinin__InfluenzaA__AHC60623
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRNGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10779 - protein, 566 aa, Artificial Sequence; identical to SEQ ID NO: 9074
  hemagglutinin__InfluenzaA__AHC60635

SEQ ID NO: 10780 - protein, 566 aa, Artificial Sequence
  hemagglutinin__InfluenzaA__AHC60647
MKTIIALSYILCLVFTQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10781 - protein, 566 aa, Artificial Sequence
  hemagglutinin__InfluenzaA__AHC60659
MKTIIALSYILCLVFTQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10782 - protein, 566 aa, Artificial Sequence
  hemagglutinin__InfluenzaA__AHC60671
MKTIIALSYILCLVFAQKLPGNDNSTATLCLGHHAVPNGTIVKTITNDQIEVTNATELVQSSSTGEICNSPHQILDGENCTLIDALLGDPQCDGFQNKEWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10783 - protein, 566 aa, Artificial Sequence
  hemagglutinin__InfluenzaA__AHC60683
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIIRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10784 - protein, 566 aa, Artificial Sequence
  hemagglutinin__InfluenzaA__AHC60695
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACMRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10785 - protein, 566 aa, Artificial Sequence
  hemagglutinin__InfluenzaA__AHC60707
MKTIIALSYILCLVFAQKLPGNDNSTATLCLGHHAVPNGTIVKTITDDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWIIWISFAISCFLLCVALLGFIMWACQKGNIRCNICI

SEQ ID NO: 10786 - protein, 566 aa, Artificial Sequence; identical to SEQ ID NO: 6855
  hemagglutinin__InfluenzaA__AHC60719

SEQ ID NO: 10787 - protein, 566 aa, Artificial Sequence; identical to SEQ ID NO: 6982
  hemagglutinin__InfluenzaA__AHC60731

SEQ ID NO: 10788 - protein, 566 aa, Artificial Sequence; identical to SEQ ID NO: 10693
  hemagglutinin__InfluenzaA__AHC60743

SEQ ID NO: 10789 - protein, 566 aa, Artificial Sequence; identical to SEQ ID NO: 3411
  hemagglutinin__InfluenzaA__AHC60767

SEQ ID NO: 10790 - protein, 566 aa, Artificial Sequence
  hemagglutinin__InfluenzaA__AHC60779
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNERFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10791 - protein, 566 aa, Artificial Sequence; identical to SEQ ID NO: 6982
  hemagglutinin__InfluenzaA__AHC60791

SEQ ID NO: 10792 - protein, 566 aa, Artificial Sequence; identical to SEQ ID NO: 10651
  hemagglutinin__InfluenzaA__AHC60803

SEQ ID NO: 10793 - protein, 566 aa, Artificial Sequence; identical to SEQ ID NO: 6855
  hemagglutinin__InfluenzaA__AHC60815

SEQ ID NO: 10794 - protein, 566 aa, Artificial Sequence
  hemagglutinin__InfluenzaA__AHC60827
MKTIIALSYILCLVFAQKLPGNDNSTATLCLGHHAVPNGTIVKTITNDQIEVTNATELVQSSSTDEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10795 - protein, 566 aa, Artificial Sequence; identical to SEQ ID NO: 10629
  hemagglutinin__InfluenzaA__AHC60839

SEQ ID NO: 10796 - protein, 566 aa, Artificial Sequence; identical to SEQ ID NO: 6982
  hemagglutinin__InfluenzaA__AHC60851

SEQ ID NO: 10797 - protein, 566 aa, Artificial Sequence
  hemagglutinin__InfluenzaA__AHC60863
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKAGYKDWILWISFAISCFLLCVALLGFIMWACQKGNIRCNICI

SEQ ID NO: 10798 - protein, 566 aa, Artificial Sequence; identical to SEQ ID NO: 6982
  hemagglutinin__InfluenzaA__AHC60875

SEQ ID NO: 10799 - protein, 566 aa, Artificial Sequence; identical to SEQ ID NO: 6982
  hemagglutinin__InfluenzaA__AHC60887

SEQ ID NO: 10800 - protein, 566 aa, Artificial Sequence; identical to SEQ ID NO: 3411
  hemagglutinin__InfluenzaA__AHC60899

SEQ ID NO: 10801 - protein, 566 aa, Artificial Sequence; identical to SEQ ID NO: 7782
  hemagglutinin__InfluenzaA__AHC60911

SEQ ID NO: 10802 - protein, 566 aa, Artificial Sequence; identical to SEQ ID NO: 10618
  hemagglutinin__InfluenzaA__AHC60923

SEQ ID NO: 10803 - protein, 566 aa, Artificial Sequence; identical to SEQ ID NO: 7782
  hemagglutinin__InfluenzaA__AHC60935

SEQ ID NO: 10804 - protein, 566 aa, Artificial Sequence; identical to SEQ ID NO: 6982
  hemagglutinin__InfluenzaA__AHC60947

SEQ ID NO: 10805 - protein, 566 aa, Artificial Sequence; identical to SEQ ID NO: 7782
  hemagglutinin__InfluenzaA__AHC60959

SEQ ID NO: 10806 - protein, 566 aa, Artificial Sequence; identical to SEQ ID NO: 6855
  hemagglutinin__InfluenzaA__AHC60971

SEQ ID NO: 10807 - protein, 566 aa, Artificial Sequence; identical to SEQ ID NO: 7782
  hemagglutinin__InfluenzaA__AHC60983

SEQ ID NO: 10808 - protein, 566 aa, Artificial Sequence; identical to SEQ ID NO: 6982
  hemagglutinin__InfluenzaA__AHC61007

SEQ ID NO: 10809 - protein, 566 aa, Artificial Sequence; identical to SEQ ID NO: 6855
  hemagglutinin__InfluenzaA__AHC61019

SEQ ID NO: 10810 - protein, 566 aa, Artificial Sequence
  hemagglutinin__InfluenzaA__AHC61031
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 10811 - protein, 566 aa, Artificial Sequence; identical to SEQ ID NO: 7782
  hemagglutinin__InfluenzaA__AHC61043

SEQ ID NO: 10812 - protein, 566 aa, Artificial Sequence
  hemagglutinin__InfluenzaA__AHC61055
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQNLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10813 - protein, 566 aa, Artificial Sequence; identical to SEQ ID NO: 10679
  hemagglutinin__InfluenzaA__AHC61067

SEQ ID NO: 10814 - protein, 566 aa, Artificial Sequence; identical to SEQ ID NO: 9074
  hemagglutinin__InfluenzaA__AHC61079

SEQ ID NO: 10815 - protein, 566 aa, Artificial Sequence; identical to SEQ ID NO: 6982
  hemagglutinin__InfluenzaA__AHC61103

SEQ ID NO: 10816 - protein, 566 aa, Artificial Sequence; identical to SEQ ID NO: 6982
  hemagglutinin__InfluenzaA__AHC61115

SEQ ID NO: 10817 - protein, 566 aa, Artificial Sequence; identical to SEQ ID NO: 7782
  hemagglutinin__InfluenzaA__AHC61127

SEQ ID NO: 10818 - protein, 566 aa, Artificial Sequence
  hemagglutinin__InfluenzaA__AHC61139
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTQRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10819 - protein, 566 aa, Artificial Sequence; identical to SEQ ID NO: 6982
  hemagglutinin__InfluenzaA__AHC61151

SEQ ID NO: 10820 - protein, 566 aa, Artificial Sequence
  hemagglutinin__InfluenzaA__AHC61163
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFKNESFNWTGVTQNGTSSACIRRSNNSFFSRLNWLTHLNFKYPALNVTMPNNEQFDKLYIWGVHHPGTDKDQIFLYAQASGRITVSTKRSQQAVVPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10821 - protein, 566 aa, Artificial Sequence; identical to SEQ ID NO: 7782
  hemagglutinin__InfluenzaA__AHC61175

SEQ ID NO: 10822 - protein, 566 aa, Artificial Sequence; identical to SEQ ID NO: 6982
  hemagglutinin__InfluenzaA__AHC61187

SEQ ID NO: 10823 - protein, 566 aa, Artificial Sequence; identical to SEQ ID NO: 6855
  hemagglutinin__InfluenzaA__AHC61199

SEQ ID NO: 10824 - protein, 566 aa, Artificial Sequence; identical to SEQ ID NO: 10618
  hemagglutinin__InfluenzaA__AHC61211

SEQ ID NO: 10825 - protein, 566 aa, Artificial Sequence; identical to SEQ ID NO: 6855
  hemagglutinin__InfluenzaA__AHC61223

SEQ ID NO: 10826 - protein, 566 aa, Artificial Sequence; identical to SEQ ID NO: 6982
  hemagglutinin__InfluenzaA__AHC61235

SEQ ID NO: 10827 - protein, 566 aa, Artificial Sequence; identical to SEQ ID NO: 7782
  hemagglutinin__InfluenzaA__AHC61247

SEQ ID NO: 10828 - protein, 566 aa, Artificial Sequence; identical to SEQ ID NO: 7782
  hemagglutinin__InfluenzaA__AHC61259

SEQ ID NO: 10829 - protein, 566 aa, Artificial Sequence; identical to SEQ ID NO: 6982
  hemagglutinin__InfluenzaA__AHC61271

SEQ ID NO: 10830 - protein, 566 aa, Artificial Sequence; identical to SEQ ID NO: 6855
  hemagglutinin__InfluenzaA__AHC61283

SEQ ID NO: 10831 - protein, 566 aa, Artificial Sequence; identical to SEQ ID NO: 9074
  hemagglutinin__InfluenzaA__AHC61295

SEQ ID NO: 10832 - protein, 566 aa, Artificial Sequence; identical to SEQ ID NO: 10686
  hemagglutinin__InfluenzaA__AHC61307

SEQ ID NO: 10833 - protein, 566 aa, Artificial Sequence; identical to SEQ ID NO: 6982
  hemagglutinin__InfluenzaA__AHC61319

SEQ ID NO: 10834 - protein, 566 aa, Artificial Sequence; identical to SEQ ID NO: 10618
  hemagglutinin__InfluenzaA__AHC61331

SEQ ID NO: 10835 - protein, 566 aa, Artificial Sequence
  hemagglutinin__InfluenzaA__AHC61343
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10836 - protein, 566 aa, Artificial Sequence; identical to SEQ ID NO: 6855
  hemagglutinin__InfluenzaA__AHC61355

SEQ ID NO: 10837 - protein, 566 aa, Artificial Sequence; identical to SEQ ID NO: 6855
  hemagglutinin__InfluenzaA__AHC61367

SEQ ID NO: 10838 - protein, 566 aa, Artificial Sequence; identical to SEQ ID NO: 6982
  hemagglutinin__InfluenzaA__AHC61379

SEQ ID NO: 10839 - protein, 566 aa, Artificial Sequence; identical to SEQ ID NO: 6855
  hemagglutinin__InfluenzaA__AHC61391

SEQ ID NO: 10840 - protein, 566 aa, Artificial Sequence
  hemagglutinin__InfluenzaA__AHC61403
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACSRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10841 - protein, 566 aa, Artificial Sequence; identical to SEQ ID NO: 6982
  hemagglutinin__InfluenzaA__AHC61415

SEQ ID NO: 10842 - protein, 566 aa, Artificial Sequence
  hemagglutinin__InfluenzaA__AHC61427
MKTIIALSYILCLVFAQKLPGNDNSTATLCLGHHAVPNGTIVKTITNDQIEVTNATELVQSSSTGEICNSPHQILDGENCTLIDALLGDPQCDGFQNNKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIIRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10843 - protein, 566 aa, Artificial Sequence
  hemagglutinin__InfluenzaA__AHC61439
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSTCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10844 - protein, 566 aa, Artificial Sequence; identical to SEQ ID NO: 6855
  hemagglutinin__InfluenzaA__AHC61451

SEQ ID NO: 10845 - protein, 566 aa, Artificial Sequence; identical to SEQ ID NO: 6855
  hemagglutinin__InfluenzaA__AHC61463

SEQ ID NO: 10846 - protein, 566 aa, Artificial Sequence; identical to SEQ ID NO: 7782
  hemagglutinin__InfluenzaA__AHC61475

SEQ ID NO: 10847 - protein, 566 aa, Artificial Sequence; identical to SEQ ID NO: 6982
  hemagglutinin__InfluenzaA__AHC61487

SEQ ID NO: 10848 - protein, 566 aa, Artificial Sequence; identical to SEQ ID NO: 7782
  hemagglutinin__InfluenzaA__AHC61499

SEQ ID NO: 10849 - protein, 566 aa, Artificial Sequence; identical to SEQ ID NO: 6855
  hemagglutinin__InfluenzaA__AHC61511

SEQ ID NO: 10850 - protein, 566 aa, Artificial Sequence; identical to SEQ ID NO: 9074
  hemagglutinin__InfluenzaA__AHC61523

SEQ ID NO: 10851 - protein, 566 aa, Artificial Sequence
  hemagglutinin__InfluenzaA__AHC61535
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMTKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10852 - protein, 566 aa, Artificial Sequence; identical to SEQ ID NO: 6855
  hemagglutinin__InfluenzaA__AHC61547

SEQ ID NO: 10853 - protein, 566 aa, Artificial Sequence
  hemagglutinin__InfluenzaA__AHC61559
MKTIIALSYILCLVFAQKLPGNDNSTATLCLGHHAVPNGTIVKTITNDQIEVTNATELVQNSSTGEICDSPHQIIDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIRKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGHKDWILWISFAISCFLLCVALLGFIMWACQKGNIRCNICI

SEQ ID NO: 10854 - protein, 566 aa, Artificial Sequence; identical to SEQ ID NO: 9074
  hemagglutinin__InfluenzaA__AHC61571

SEQ ID NO: 10855 - protein, 566 aa, Artificial Sequence; identical to SEQ ID NO: 6855
  hemagglutinin__InfluenzaA__AHC61583

SEQ ID NO: 10856 - protein, 566 aa, Artificial Sequence; identical to SEQ ID NO: 9074
  hemagglutinin__InfluenzaA__AHC61595

SEQ ID NO: 10857 - protein, 566 aa, Artificial Sequence
  hemagglutinin__InfluenzaA__AHC61607
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQHTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10858 - protein, 566 aa, Artificial Sequence; identical to SEQ ID NO: 9074
  hemagglutinin__InfluenzaA__AHC61619

SEQ ID NO: 10859 - protein, 566 aa, Artificial Sequence
  hemagglutinin__InfluenzaA__AHC61631
MKTIIALSYILCLVFAQKLPGNDNSTATLCLGHHAVPNGTIVKTITNDQIEVTNATELVQSSSTGEICNSPHQILDGENCTIIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10860 - protein, 566 aa, Artificial Sequence
  hemagglutinin__InfluenzaA__AHC61643
MKTIIALSYVLCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10861 - protein, 566 aa, Artificial Sequence
  hemagglutinin__InfluenzaA__AHC61655
MKTIIALSYILCLVFTQKLPGNDNSTATLCLGHHAVPNGTIVKTITNDQIEVTNATELVQSSSTGEICNSPHQILDGENCTLIDALLGDPQCDGFQNNKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIIRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10862 - protein, 566 aa, Artificial Sequence
  hemagglutinin__InfluenzaA__AHC61667
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10863 - protein, 566 aa, Artificial Sequence; identical to SEQ ID NO: 10618
  hemagglutinin__InfluenzaA__AHC61679

SEQ ID NO: 10864 - protein, 566 aa, Artificial Sequence; identical to SEQ ID NO: 9074
  hemagglutinin__InfluenzaA__AHC61691

SEQ ID NO: 10865 - protein, 566 aa, Artificial Sequence; identical to SEQ ID NO: 6855
  hemagglutinin__InfluenzaA__AHC61703

SEQ ID NO: 10866 - protein, 566 aa, Artificial Sequence; identical to SEQ ID NO: 10651
  hemagglutinin__InfluenzaA__AHC61715

SEQ ID NO: 10867 - protein, 566 aa, Artificial Sequence; identical to SEQ ID NO: 7782
  hemagglutinin__InfluenzaA__AHC61727

SEQ ID NO: 10868 - protein, 566 aa, Artificial Sequence; identical to SEQ ID NO: 6855
  hemagglutinin__InfluenzaA__AHC61739

SEQ ID NO: 10869 - protein, 566 aa, Artificial Sequence
  hemagglutinin__InfluenzaA__AHC61751
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNVGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10870 - protein, 566 aa, Artificial Sequence
  hemagglutinin__InfluenzaA__AHC61763
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQTVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10871 - protein, 566 aa, Artificial Sequence; identical to SEQ ID NO: 6982
  hemagglutinin__InfluenzaA__AHC61775

SEQ ID NO: 10872 - protein, 566 aa, Artificial Sequence; identical to SEQ ID NO: 7782
  hemagglutinin__InfluenzaA__AHC61787

SEQ ID NO: 10873 - protein, 566 aa, Artificial Sequence; identical to SEQ ID NO: 10618
  hemagglutinin__InfluenzaA__AHC61799

SEQ ID NO: 10874 - protein, 566 aa, Artificial Sequence
  hemagglutinin__InfluenzaA__AHC61823
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMKSDAPIDKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10875 - protein, 566 aa, Artificial Sequence; identical to SEQ ID NO: 7782
  hemagglutinin__InfluenzaA__AHC61835

SEQ ID NO: 10876 - protein, 566 aa, Artificial Sequence; identical to SEQ ID NO: 6982
  hemagglutinin__InfluenzaA__AHC61847

SEQ ID NO: 10877 - protein, 566 aa, Artificial Sequence; identical to SEQ ID NO: 6855
  hemagglutinin__InfluenzaA__AHC61859

SEQ ID NO: 10878 - protein, 566 aa, Artificial Sequence; identical to SEQ ID NO: 7782
  hemagglutinin__InfluenzaA__AHC61871

SEQ ID NO: 10879 - protein, 566 aa, Artificial Sequence
  hemagglutinin__InfluenzaA__AHC61883
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLADSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10880 - protein, 566 aa, Artificial Sequence; identical to SEQ ID NO: 6982
  hemagglutinin__InfluenzaA__AHC61895

SEQ ID NO: 10881 - protein, 566 aa, Artificial Sequence; identical to SEQ ID NO: 6982
  hemagglutinin__InfluenzaA__AHC61907

SEQ ID NO: 10882 - protein, 566 aa, Artificial Sequence
  hemagglutinin__InfluenzaA__AHC61931
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKGWILWISFAISCFLLCVALLGFIMWACQKGNIRCNICI

SEQ ID NO: 10883 - protein, 566 aa, Artificial Sequence; identical to SEQ ID NO: 7782
  hemagglutinin__InfluenzaA__AHC61943

SEQ ID NO: 10884 - protein, 566 aa, Artificial Sequence; identical to SEQ ID NO: 9074
  hemagglutinin__InfluenzaA__AHC61955

SEQ ID NO: 10885 - protein, 566 aa, Artificial Sequence; identical to SEQ ID NO: 7782
  hemagglutinin__InfluenzaA__AHC61967

SEQ ID NO: 10886 - protein, 566 aa, Artificial Sequence; identical to SEQ ID NO: 6855
  hemagglutinin__InfluenzaA__AHC61979

SEQ ID NO: 10887 - protein, 566 aa, Artificial Sequence; identical to SEQ ID NO: 6982
  hemagglutinin__InfluenzaA__AHC61991

SEQ ID NO: 10888 - protein, 566 aa, Artificial Sequence; identical to SEQ ID NO: 10693
  hemagglutinin__InfluenzaA__AHC62003

SEQ ID NO: 10889 - protein, 566 aa, Artificial Sequence; identical to SEQ ID NO: 7782
  hemagglutinin__InfluenzaA__AHC62015

SEQ ID NO: 10890 - protein, 566 aa, Artificial Sequence; identical to SEQ ID NO: 9074
  hemagglutinin__InfluenzaA__AHC62027

SEQ ID NO: 10891 - protein, 566 aa, Artificial Sequence
  hemagglutinin__InfluenzaA__AHC62039
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMKSDAPIGKCNSACITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10892 - protein, 566 aa, Artificial Sequence
  hemagglutinin__InfluenzaA__AHC62050
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNVPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10893 - protein, 566 aa, Artificial Sequence; identical to SEQ ID NO: 9074
  hemagglutinin__InfluenzaA__AHC62062

SEQ ID NO: 10894 - protein, 566 aa, Artificial Sequence
  hemagglutinin__InfluenzaA__AHC62074
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRNQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10895 - protein, 566 aa, Artificial Sequence; identical to SEQ ID NO: 6855
  hemagglutinin__InfluenzaA__AHC62086

SEQ ID NO: 10896 - protein, 566 aa, Artificial Sequence; identical to SEQ ID NO: 7782
  hemagglutinin__InfluenzaA__AHC62098

SEQ ID NO: 10897 - protein, 566 aa, Artificial Sequence; identical to SEQ ID NO: 6855
  hemagglutinin__InfluenzaA__AHC62110

SEQ ID NO: 10898 - protein, 566 aa, Artificial Sequence
  hemagglutinin__InfluenzaA__AHC62122
MKTIIALSYILCLVFAQKLPGNDNSTATLCLGHHAVPNGTIVKTITNDQIEVTNATEMVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHSNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFRIKGVELKSGYKDWILWISFAISCFLLCVALLGFIMWACQKGNIRCNICI

SEQ ID NO: 10899 - protein, 566 aa, Artificial Sequence; identical to SEQ ID NO: 6855
  hemagglutinin__InfluenzaA__AHC62134

SEQ ID NO: 10900 - protein, 566 aa, Artificial Sequence
  hemagglutinin__InfluenzaA__AHC62146
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNYEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10901 - protein, 566 aa, Artificial Sequence; identical to SEQ ID NO: 6982
  hemagglutinin__InfluenzaA__AHC62158

SEQ ID NO: 10902 - protein, 566 aa, Artificial Sequence
  hemagglutinin__InfluenzaA__AHC62170
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10903 - protein, 566 aa, Artificial Sequence; identical to SEQ ID NO: 6855
  hemagglutinin__InfluenzaA__AHC62182

SEQ ID NO: 10904 - protein, 566 aa, Artificial Sequence; identical to SEQ ID NO: 9074
  hemagglutinin__InfluenzaA__AHC62194

SEQ ID NO: 10905 - protein, 566 aa, Artificial Sequence
  hemagglutinin__InfluenzaA__AHC62206
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFIWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 10906 - protein, 566 aa, Artificial Sequence; identical to SEQ ID NO: 6982
  hemagglutinin__InfluenzaA__AHC62218

SEQ ID NO: 10907 - protein, 566 aa, Artificial Sequence
  hemagglutinin__InfluenzaA__AHC62242
MKTIIALSYILCLVFAQKIPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLIALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10908 - protein, 566 aa, Artificial Sequence; identical to SEQ ID NO: 10617
  hemagglutinin__InfluenzaA__AHC62254

SEQ ID NO: 10909 - protein, 566 aa, Artificial Sequence; identical to SEQ ID NO: 6982
  hemagglutinin__InfluenzaA__AHC62266

SEQ ID NO: 10910 - protein, 566 aa, Artificial Sequence; identical to SEQ ID NO: 10781
  hemagglutinin__InfluenzaA__AHC62278

SEQ ID NO: 10911 - protein, 566 aa, Artificial Sequence
  hemagglutinin__InfluenzaA__AHC62290
MKTIIALSYILCLIFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10912 - protein, 566 aa, Artificial Sequence
  hemagglutinin__InfluenzaA__AHC62302
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRNGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10913 - protein, 566 aa, Artificial Sequence
  hemagglutinin__InfluenzaA__AHC62314
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIRGVELKSGYKDWILWISFAISCFLLCVALLGFIMWACQKGNIRCNICI

SEQ ID NO: 10914 - protein, 566 aa, Artificial Sequence; identical to SEQ ID NO: 10778
  hemagglutinin__InfluenzaA__AHC62326

SEQ ID NO: 10915 - protein, 566 aa, Artificial Sequence; identical to SEQ ID NO: 7782
  hemagglutinin__InfluenzaA__AHC62338

SEQ ID NO: 10916 - protein, 566 aa, Artificial Sequence; identical to SEQ ID NO: 6855
  hemagglutinin__InfluenzaA__AHC62350

SEQ ID NO: 10917 - protein, 566 aa, Artificial Sequence; identical to SEQ ID NO: 7782
  hemagglutinin__InfluenzaA__AHC62362

SEQ ID NO: 10918 - protein, 566 aa, Artificial Sequence; identical to SEQ ID NO: 7782
  hemagglutinin__InfluenzaA__AHC62374

SEQ ID NO: 10919 - protein, 566 aa, Artificial Sequence; identical to SEQ ID NO: 10781
  hemagglutinin__InfluenzaA__AHC62386

SEQ ID NO: 10920 - protein, 566 aa, Artificial Sequence; identical to SEQ ID NO: 6855
  hemagglutinin__InfluenzaA__AHC62398

SEQ ID NO: 10921 - protein, 566 aa, Artificial Sequence
  hemagglutinin__InfluenzaA__AHC62410
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIIRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10922 - protein, 566 aa, Artificial Sequence; identical to SEQ ID NO: 10724
  hemagglutinin__InfluenzaA__AHC62422

SEQ ID NO: 10923 - protein, 566 aa, Artificial Sequence
  hemagglutinin__InfluenzaA__AHC62434
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIQSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10924 - protein, 566 aa, Artificial Sequence; identical to SEQ ID NO: 6855
  hemagglutinin__InfluenzaA__AHC62446

SEQ ID NO: 10925 - protein, 566 aa, Artificial Sequence; identical to SEQ ID NO: 6982
  hemagglutinin__InfluenzaA__AHC62458

SEQ ID NO: 10926 - protein, 566 aa, Artificial Sequence
  hemagglutinin__InfluenzaA__AHC62470
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10927 - protein, 566 aa, Artificial Sequence; identical to SEQ ID NO: 10679
  hemagglutinin__InfluenzaA__AHC62482

SEQ ID NO: 10928 - protein, 566 aa, Artificial Sequence; identical to SEQ ID NO: 6855
  hemagglutinin__InfluenzaA__AHC62506

SEQ ID NO: 10929 - protein, 566 aa, Artificial Sequence; identical to SEQ ID NO: 6982
  hemagglutinin__InfluenzaA__AHC62518

SEQ ID NO: 10930 - protein, 566 aa, Artificial Sequence
  hemagglutinin__InfluenzaA__AHC62530
MKTIIALSYILCLVFAQKIPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10931 - protein, 566 aa, Artificial Sequence; identical to SEQ ID NO: 10651
  hemagglutinin__InfluenzaA__AHC62542

SEQ ID NO: 10932 - protein, 566 aa, Artificial Sequence; identical to SEQ ID NO: 6855
  hemagglutinin__InfluenzaA__AHC62554

SEQ ID NO: 10933 - protein, 566 aa, Artificial Sequence
  hemagglutinin__InfluenzaA__AHC62566
MKTIIALSYILCLVFAQKLPGNDNSTATLCLGHHAVPNGTMVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10934 - protein, 566 aa, Artificial Sequence; identical to SEQ ID NO: 6855
  hemagglutinin__InfluenzaA__AHC62578

SEQ ID NO: 10935 - protein, 566 aa, Artificial Sequence; identical to SEQ ID NO: 6855
  hemagglutinin__InfluenzaA__AHC62590

SEQ ID NO: 10936 - protein, 566 aa, Artificial Sequence; identical to SEQ ID NO: 6982
  hemagglutinin__InfluenzaA__AHC62602

SEQ ID NO: 10937 - protein, 566 aa, Artificial Sequence
  hemagglutinin__InfluenzaA__AHC62614
MKTIIALSYILCLVFAQKLPGNDNSTATLCLGHHAVPNGTIVKTITNDQIEVTNATELVQSSSTGEICNSPHQIIDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10938 - protein, 566 aa, Artificial Sequence; identical to SEQ ID NO: 10618
  hemagglutinin__InfluenzaA__AHC62626

SEQ ID NO: 10939 - protein, 566 aa, Artificial Sequence; identical to SEQ ID NO: 6982
  hemagglutinin__InfluenzaA__AHC62638

SEQ ID NO: 10940 - protein, 566 aa, Artificial Sequence; identical to SEQ ID NO: 10782
  hemagglutinin__InfluenzaA__AHC62650

SEQ ID NO: 10941 - protein, 566 aa, Artificial Sequence
  hemagglutinin__InfluenzaA__AHC62662
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSSCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10942 - protein, 566 aa, Artificial Sequence
  hemagglutinin__InfluenzaA__AHC62674
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLIASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNTCIESIRNGTYDHDVYRDEALNNRFQIKGVELKSGYKDWILWISFAISCFLLCVALLGFIMWACQKGNIRCNICI

SEQ ID NO: 10943 - protein, 566 aa, Artificial Sequence; identical to SEQ ID NO: 10060
  hemagglutinin__InfluenzaA__AHE37972

SEQ ID NO: 10944 - protein, 566 aa, Artificial Sequence
  hemagglutinin__InfluenzaA__AHE37973
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGTKSFYKNLIWLVKKGNSYPKLSKSYINDKGKEVLVLWGIHHPSTTADQQSLYQNADAYVFVGTSRYSKKFKPEIAIRPKVRDQEGRINYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10945 - protein, 566 aa, Artificial Sequence
  hemagglutinin__InfluenzaA__AHE37974
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSKYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10946 - protein, 566 aa, Artificial Sequence; identical to SEQ ID NO: 10040
  hemagglutinin__InfluenzaA__AHE37975

SEQ ID NO: 10947 - protein, 566 aa, Artificial Sequence
  hemagglutinin__InfluenzaA__AHE37976
MKAILVVLLYTFATANADTLCIGYHANNSTDTVDTVLEKNVTVTHSVNLLEDKHNGKLCKLRGVAPLHLGKCNIAGWILGNPECESLSAASSWSYIVETSSSNNGTCYPGDFINYEELREQLSSVSSFERFEIFPKTSSWPNHDSNKGVTAACPHAGAKSFYKNLIWLVKKGNSYPKLSKSYINDKGKEILVLWGIHHPSTTTDQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNRGKIDGVKLESTRIYQILAIYSTVASSLVLVVSLGAISFWMCSNGSLQCRICI

SEQ ID NO: 10948 - protein, 566 aa, Artificial Sequence; identical to SEQ ID NO: 10040
  hemagglutinin__InfluenzaA__AHE37977

SEQ ID NO: 10949 - protein, 566 aa, Artificial Sequence; identical to SEQ ID NO: 10060
  hemagglutinin__InfluenzaA__AHE37978

SEQ ID NO: 10950 - protein, 566 aa, Artificial Sequence; identical to SEQ ID NO: 10040
  hemagglutinin__InfluenzaA__AHE37979

SEQ ID NO: 10951 - protein, 566 aa, Artificial Sequence
  hemagglutinin__InfluenzaA__AHE37980
MKAILVVLLYTFATANADTLCIGYHANNSTDTVDTVLEKNVTVTHSVNLLEDKHNGKLCKLRGVTPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10952 - protein, 566 aa, Artificial Sequence
  hemagglutinin__InfluenzaA__AHE37981
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSKYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNIQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10953 - protein, 566 aa, Artificial Sequence; identical to SEQ ID NO: 10040
  hemagglutinin__InfluenzaA__AHE37982

SEQ ID NO: 10954 - protein, 566 aa, Artificial Sequence
  hemagglutinin__InfluenzaA__AHE37983
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSESYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10955 - protein, 566 aa, Artificial Sequence
  hemagglutinin__InfluenzaA__AHE37984
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10956 - protein, 566 aa, Artificial Sequence
  hemagglutinin__InfluenzaA__AHE37985
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMKSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10957 - protein, 566 aa, Artificial Sequence; identical to SEQ ID NO: 9922
  hemagglutinin__InfluenzaA__AHE37986

SEQ ID NO: 10958 - protein, 566 aa, Artificial Sequence; identical to SEQ ID NO: 9858
  hemagglutinin__InfluenzaA__AHE37987

SEQ ID NO: 10959 - protein, 566 aa, Artificial Sequence
  hemagglutinin__InfluenzaA__AHE37988
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQNLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 10960 - protein, 566 aa, Artificial Sequence; identical to SEQ ID NO: 9994
  hemagglutinin__InfluenzaA__AHE37989

SEQ ID NO: 10961 - protein, 566 aa, Artificial Sequence; identical to SEQ ID NO: 9858
  hemagglutinin__InfluenzaA__AHE37990

SEQ ID NO: 10962 - protein, 566 aa, Artificial Sequence; identical to SEQ ID NO: 9858
  hemagglutinin__InfluenzaA__AHE37991

SEQ ID NO: 10963 - protein, 566 aa, Artificial Sequence
  hemagglutinin__InfluenzaA__AHE37992
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFDNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 10964 - protein, 566 aa, Artificial Sequence; identical to SEQ ID NO: 10040
  hemagglutinin__InfluenzaA__AHE38023

SEQ ID NO: 10965 - protein, 566 aa, Artificial Sequence
  hemagglutinin__InfluenzaA__AHE38024
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10966 - protein, 566 aa, Artificial Sequence
  hemagglutinin__InfluenzaA__AHE38026
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINEKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10967 - protein, 566 aa, Artificial Sequence; identical to SEQ ID NO: 9883
  hemagglutinin__InfluenzaA__AHE38027

SEQ ID NO: 10968 - protein, 560 aa, Artificial Sequence
  hemagglutinin__InfluenzaA__AHF20558
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVQNGNMRCTIGI

SEQ ID NO: 10969 - protein, 560 aa, Artificial Sequence
  hemagglutinin__InfluenzaA__AHF20568
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIMSNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 10970 - protein, 565 aa, Artificial Sequence; identical to SEQ ID NO: 7793
  hemagglutinin__InfluenzaA__AHG96108

SEQ ID NO: 10971 - protein, 565 aa, Artificial Sequence; identical to SEQ ID NO: 7793
  hemagglutinin__InfluenzaA__AHG96120

SEQ ID NO: 10972 - protein, 565 aa, Artificial Sequence; identical to SEQ ID NO: 7793
  hemagglutinin__InfluenzaA__AHG96132

SEQ ID NO: 10973 - protein, 565 aa, Artificial Sequence
  hemagglutinin__InfluenzaA__AHG96144
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGVQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 10974 - protein, 565 aa, Artificial Sequence; identical to SEQ ID NO: 7793
  hemagglutinin__InfluenzaA__AHG96156

SEQ ID NO: 10975 - protein, 565 aa, Artificial Sequence; identical to SEQ ID NO: 7793
  hemagglutinin__InfluenzaA__AHG96168

SEQ ID NO: 10976 - protein, 565 aa, Artificial Sequence; identical to SEQ ID NO: 7793
  hemagglutinin__InfluenzaA__AHG96180

SEQ ID NO: 10977 - protein, 565 aa, Artificial Sequence; identical to SEQ ID NO: 7793
  hemagglutinin__InfluenzaA__AHG96192

SEQ ID NO: 10978 - protein, 565 aa, Artificial Sequence; identical to SEQ ID NO: 7793
  hemagglutinin__InfluenzaA__AHG96204

SEQ ID NO: 10979 - protein, 565 aa, Artificial Sequence; identical to SEQ ID NO: 7793
  hemagglutinin__InfluenzaA__AHG96216

SEQ ID NO: 10980 - protein, 565 aa, Artificial Sequence; identical to SEQ ID NO: 7793
  hemagglutinin__InfluenzaA__AHG96228

SEQ ID NO: 10981 - protein, 565 aa, Artificial Sequence; identical to SEQ ID NO: 10973
  hemagglutinin__InfluenzaA__AHG96240

SEQ ID NO: 10982 - protein, 565 aa, Artificial Sequence; identical to SEQ ID NO: 7793
  hemagglutinin__InfluenzaA__AHG96252

SEQ ID NO: 10983 - protein, 565 aa, Artificial Sequence; identical to SEQ ID NO: 7793
  hemagglutinin__InfluenzaA__AHG96264

SEQ ID NO: 10984 - protein, 565 aa, Artificial Sequence; identical to SEQ ID NO: 7793
  hemagglutinin__InfluenzaA__AHG96276

SEQ ID NO: 10985 - protein, 565 aa, Artificial Sequence; identical to SEQ ID NO: 7793
  hemagglutinin__InfluenzaA__AHG96288

SEQ ID NO: 10986 - protein, 565 aa, Artificial Sequence; identical to SEQ ID NO: 7793
  hemagglutinin__InfluenzaA__AHG96300

SEQ ID NO: 10987 - protein, 566 aa, Artificial Sequence
  hemagglutinin__InfluenzaA__AHG96312
MKAILVVLLYTFATANADTLCIGYHANNSTDTVDTVLEKNVTVTHSVNLLEDKHNGKLCKLRGVVPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10988 - protein, 566 aa, Artificial Sequence; identical to SEQ ID NO: 10040
  hemagglutinin__InfluenzaA__AHG96313

SEQ ID NO: 10989 - protein, 566 aa, Artificial Sequence
  hemagglutinin__InfluenzaA__AHG96314
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQYTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10990 - protein, 566 aa, Artificial Sequence; identical to SEQ ID NO: 10040
  hemagglutinin__InfluenzaA__AHG96315

SEQ ID NO: 10991 - protein, 566 aa, Artificial Sequence; identical to SEQ ID NO: 10040
  hemagglutinin__InfluenzaA__AHG96316

SEQ ID NO: 10992 - protein, 566 aa, Artificial Sequence; identical to SEQ ID NO: 10040
  hemagglutinin__InfluenzaA__AHG96317

SEQ ID NO: 10993 - protein, 566 aa, Artificial Sequence; identical to SEQ ID NO: 10040
  hemagglutinin__InfluenzaA__AHG96320

SEQ ID NO: 10994 - protein, 566 aa, Artificial Sequence; identical to SEQ ID NO: 10040
  hemagglutinin__InfluenzaA__AHG96321

SEQ ID NO: 10995 - protein, 566 aa, Artificial Sequence; identical to SEQ ID NO: 10040
  hemagglutinin__InfluenzaA__AHG96322

SEQ ID NO: 10996 - protein, 566 aa, Artificial Sequence; identical to SEQ ID NO: 10040
  hemagglutinin__InfluenzaA__AHG96324

SEQ ID NO: 10997 - protein, 566 aa, Artificial Sequence; identical to SEQ ID NO: 10040
  hemagglutinin__InfluenzaA__AHG96325

SEQ ID NO: 10998 - protein, 566 aa, Artificial Sequence
  hemagglutinin__InfluenzaA__AHG96326
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 10999 - protein, 566 aa, Artificial Sequence; identical to SEQ ID NO: 10040
  hemagglutinin__InfluenzaA__AHG96327

SEQ ID NO: 11000 - protein, 566 aa, Artificial Sequence
  hemagglutinin__InfluenzaA__AHG96329
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKIRNQLKNNAKEIGNGCFEFYHKCDNTCMESVKNGTYEYPKYSEEAKLNREKIDGVKLESTKIYQILAIYSTVASSLVLVVSLGAISFWMCSNGSLQCRICI

SEQ ID NO: 11001 - protein, 566 aa, Artificial Sequence
  hemagglutinin__InfluenzaA__AHG96330
MKAILVVLLYTFATATADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLSLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKIRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11002 - protein, 566 aa, Artificial Sequence; identical to SEQ ID NO: 10040
  hemagglutinin__InfluenzaA__AHG96332

SEQ ID NO: 11003 - protein, 566 aa, Artificial Sequence
  hemagglutinin__InfluenzaA__AHG96334
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11004 - protein, 566 aa, Artificial Sequence
  hemagglutinin__InfluenzaA__AHG96335
MKAILVVLLYTFETANADTLCIGYHANNSTDTVDTVLEKNVTVTHSVNLLEDKHNGKLCKLKGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11005 - protein, 566 aa, Artificial Sequence
  hemagglutinin__InfluenzaA__AHG96336
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVRDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11006 - protein, 566 aa, Artificial Sequence
  hemagglutinin__InfluenzaA__AHG96338
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACSHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11007 - protein, 566 aa, Artificial Sequence
  hemagglutinin__InfluenzaA__AHG96339
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEILVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11008 - protein, 566 aa, Artificial Sequence; identical to SEQ ID NO: 10040
  hemagglutinin__InfluenzaA__AHG96340

SEQ ID NO: 11009 - protein, 566 aa, Artificial Sequence
  hemagglutinin__InfluenzaA__AHG96341
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSKYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11010 - protein, 566 aa, Artificial Sequence
  hemagglutinin__InfluenzaA__AHG96342
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNMCMESVKNGTYDYPKYSEEAKLNREKIDGVKLESTRIYQILAIYSTVASSLVLVVSLGAISFWMCSNGSLQCRICI

SEQ ID NO: 11011 - protein, 566 aa, Artificial Sequence
  hemagglutinin__InfluenzaA__AHG96343
MKAILVVLLYTFATATADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11012 - protein, 566 aa, Artificial Sequence; identical to SEQ ID NO: 10040
  hemagglutinin__InfluenzaA__AHG96344

SEQ ID NO: 11013 - protein, 566 aa, Artificial Sequence; identical to SEQ ID NO: 11003
  hemagglutinin__InfluenzaA__AHG96345

SEQ ID NO: 11014 - protein, 566 aa, Artificial Sequence; identical to SEQ ID NO: 10040
  hemagglutinin__InfluenzaA__AHG96346

SEQ ID NO: 11015 - protein, 566 aa, Artificial Sequence; identical to SEQ ID NO: 10040
  hemagglutinin__InfluenzaA__AHG96347

SEQ ID NO: 11016 - protein, 566 aa, Artificial Sequence; identical to SEQ ID NO: 10040
  hemagglutinin__InfluenzaA__AHG96348

SEQ ID NO: 11017 - protein, 566 aa, Artificial Sequence; identical to SEQ ID NO: 10040
  hemagglutinin__InfluenzaA__AHG96349

SEQ ID NO: 11018 - protein, 566 aa, Artificial Sequence; identical to SEQ ID NO: 10040
  hemagglutinin__InfluenzaA__AHG96350

SEQ ID NO: 11019 - protein, 566 aa, Artificial Sequence; identical to SEQ ID NO: 10040
  hemagglutinin__InfluenzaA__AHG96351

SEQ ID NO: 11020 - protein, 566 aa, Artificial Sequence; identical to SEQ ID NO: 10040
  hemagglutinin__InfluenzaA__AHG96352

SEQ ID NO: 11021 - protein, 566 aa, Artificial Sequence
  hemagglutinin__InfluenzaA__AHG96353
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11022 - protein, 566 aa, Artificial Sequence; identical to SEQ ID NO: 10040
  hemagglutinin__InfluenzaA__AHG96354

SEQ ID NO: 11023 - protein, 566 aa, Artificial Sequence
  hemagglutinin__InfluenzaA__AHG96355
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNQLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11024 - protein, 566 aa, Artificial Sequence; identical to SEQ ID NO: 9858
  hemagglutinin__InfluenzaA__AHG96356

SEQ ID NO: 11025 - protein, 566 aa, Artificial Sequence
  hemagglutinin__InfluenzaA__AHG96359
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSSCKRRSNNSFFSRLNWLTHLKFKYPALNVTMPNNEKFDKLYIWGVHHPVTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11026 - protein, 566 aa, Artificial Sequence; identical to SEQ ID NO: 11025
  hemagglutinin__InfluenzaA__AHG96371

SEQ ID NO: 11027 - protein, 566 aa, Artificial Sequence; identical to SEQ ID NO: 11025
  hemagglutinin__InfluenzaA__AHG96383

SEQ ID NO: 11028 - protein, 565 aa, Artificial Sequence; identical to SEQ ID NO: 7793
  hemagglutinin__InfluenzaA__AHG96395

SEQ ID NO: 11029 - protein, 566 aa, Artificial Sequence; identical to SEQ ID NO: 11025
  hemagglutinin__InfluenzaA__AHG96407

SEQ ID NO: 11030 - protein, 566 aa, Artificial Sequence; identical to SEQ ID NO: 11025
  hemagglutinin__InfluenzaA__AHG96419

SEQ ID NO: 11031 - protein, 566 aa, Artificial Sequence; identical to SEQ ID NO: 11025
  hemagglutinin__InfluenzaA__AHG96431

SEQ ID NO: 11032 - protein, 566 aa, Artificial Sequence; identical to SEQ ID NO: 11025
  hemagglutinin__InfluenzaA__AHG96443

SEQ ID NO: 11033 - protein, 566 aa, Artificial Sequence; identical to SEQ ID NO: 11025
  hemagglutinin__InfluenzaA__AHG96455

SEQ ID NO: 11034 - protein, 566 aa, Artificial Sequence; identical to SEQ ID NO: 11025
  hemagglutinin__InfluenzaA__AHG96467

SEQ ID NO: 11035 - protein, 566 aa, Artificial Sequence; identical to SEQ ID NO: 11025
  hemagglutinin__InfluenzaA__AHG96479

SEQ ID NO: 11036 - protein, 566 aa, Artificial Sequence; identical to SEQ ID NO: 11025
  hemagglutinin__InfluenzaA__AHG96491

SEQ ID NO: 11037 - protein, 566 aa, Artificial Sequence; identical to SEQ ID NO: 2356
  hemagglutinin__InfluenzaA__AHG96503

SEQ ID NO: 11038 - protein, 565 aa, Artificial Sequence; identical to SEQ ID NO: 7793
  hemagglutinin__InfluenzaA__AHG96515

SEQ ID NO: 11039 - protein, 565 aa, Artificial Sequence; identical to SEQ ID NO: 7793
  hemagglutinin__InfluenzaA__AHG96527

SEQ ID NO: 11040 - protein, 565 aa, Artificial Sequence; identical to SEQ ID NO: 7793
  hemagglutinin__InfluenzaA__AHG96539

SEQ ID NO: 11041 - protein, 565 aa, Artificial Sequence; identical to SEQ ID NO: 7793
  hemagglutinin__InfluenzaA__AHG96551

SEQ ID NO: 11042 - protein, 565 aa, Artificial Sequence; identical to SEQ ID NO: 10973
  hemagglutinin__InfluenzaA__AHG96563

SEQ ID NO: 11043 - protein, 565 aa, Artificial Sequence; identical to SEQ ID NO: 7793
  hemagglutinin__InfluenzaA__AHG96575

SEQ ID NO: 11044 - protein, 565 aa, Artificial Sequence; identical to SEQ ID NO: 7793
  hemagglutinin__InfluenzaA__AHG96587

SEQ ID NO: 11045 - protein, 565 aa, Artificial Sequence; identical to SEQ ID NO: 7793
  hemagglutinin__InfluenzaA__AHG96599

SEQ ID NO: 11046 - protein, 565 aa, Artificial Sequence; identical to SEQ ID NO: 7793
  hemagglutinin__InfluenzaA__AHG96611

SEQ ID NO: 11047 - protein, 565 aa, Artificial Sequence; identical to SEQ ID NO: 7793
  hemagglutinin__InfluenzaA__AHG96623

SEQ ID NO: 11048 - protein, 565 aa, Artificial Sequence; identical to SEQ ID NO: 7793
  hemagglutinin__InfluenzaA__AHG96635

SEQ ID NO: 11049 - protein, 565 aa, Artificial Sequence; identical to SEQ ID NO: 7793
  hemagglutinin__InfluenzaA__AHG96647

SEQ ID NO: 11050 - protein, 565 aa, Artificial Sequence; identical to SEQ ID NO: 7793
  hemagglutinin__InfluenzaA__AHG96659

SEQ ID NO: 11051 - protein, 565 aa, Artificial Sequence; identical to SEQ ID NO: 7793
  hemagglutinin__InfluenzaA__AHG96671

SEQ ID NO: 11052 - protein, 565 aa, Artificial Sequence; identical to SEQ ID NO: 7793
  hemagglutinin__InfluenzaA__AHG96683

SEQ ID NO: 11053 - protein, 566 aa, Artificial Sequence; identical to SEQ ID NO: 11025
  hemagglutinin__InfluenzaA__AHG96695

SEQ ID NO: 11054 - protein, 566 aa, Artificial Sequence; identical to SEQ ID NO: 11025
  hemagglutinin__InfluenzaA__AHG96707

SEQ ID NO: 11055 - protein, 566 aa, Artificial Sequence; identical to SEQ ID NO: 11025
  hemagglutinin__InfluenzaA__AHG96719

SEQ ID NO: 11056 - protein, 566 aa, Artificial Sequence; identical to SEQ ID NO: 11025
  hemagglutinin__InfluenzaA__AHG96731

SEQ ID NO: 11057 - protein, 566 aa, Artificial Sequence; identical to SEQ ID NO: 11025
  hemagglutinin__InfluenzaA__AHG96743

SEQ ID NO: 11058 - protein, 566 aa, Artificial Sequence; identical to SEQ ID NO: 11025
  hemagglutinin__InfluenzaA__AHG96755

SEQ ID NO: 11059 - protein, 566 aa, Artificial Sequence; identical to SEQ ID NO: 11025
  hemagglutinin__InfluenzaA__AHG96767

SEQ ID NO: 11060 - protein, 566 aa, Artificial Sequence; identical to SEQ ID NO: 11025
  hemagglutinin__InfluenzaA__AHG96779

SEQ ID NO: 11061 - protein, 566 aa, Artificial Sequence
  hemagglutinin__InfluenzaA__AHG96791
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSSCKRRSNNSFFSRLNWLTQLKFKYPALNVTMPNNEKFDKLYIWGVHHPVTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVERRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11062 - protein, 566 aa, Artificial Sequence; identical to SEQ ID NO: 11025
  hemagglutinin__InfluenzaA__AHG96803

SEQ ID NO: 11063 - protein, 566 aa, Artificial Sequence; identical to SEQ ID NO: 11025
  hemagglutinin__InfluenzaA__AHG96815

SEQ ID NO: 11064 - protein, 566 aa, Artificial Sequence; identical to SEQ ID NO: 11025
  hemagglutinin__InfluenzaA__AHG96827

SEQ ID NO: 11065 - protein, 566 aa, Artificial Sequence; identical to SEQ ID NO: 11025
  hemagglutinin__InfluenzaA__AHG96839

SEQ ID NO: 11066 - protein, 566 aa, Artificial Sequence; identical to SEQ ID NO: 11025
  hemagglutinin__InfluenzaA__AHG96851

SEQ ID NO: 11067 - protein, 566 aa, Artificial Sequence; identical to SEQ ID NO: 11025
  hemagglutinin__InfluenzaA__AHG96863

SEQ ID NO: 11068 - protein, 566 aa, Artificial Sequence; identical to SEQ ID NO: 11025
  hemagglutinin__InfluenzaA__AHG96875

SEQ ID NO: 11069 - protein, 566 aa, Artificial Sequence; identical to SEQ ID NO: 11025
  hemagglutinin__InfluenzaA__AHG96887

SEQ ID NO: 11070 - protein, 566 aa, Artificial Sequence; identical to SEQ ID NO: 11025
  hemagglutinin__InfluenzaA__AHG96899

SEQ ID NO: 11071 - protein, 566 aa, Artificial Sequence; identical to SEQ ID NO: 11025
  hemagglutinin__InfluenzaA__AHG96911

SEQ ID NO: 11072 - protein, 566 aa, Artificial Sequence; identical to SEQ ID NO: 11025
  hemagglutinin__InfluenzaA__AHG96923

SEQ ID NO: 11073 - protein, 566 aa, Artificial Sequence; identical to SEQ ID NO: 11025
  hemagglutinin__InfluenzaA__AHG96935

SEQ ID NO: 11074 - protein, 566 aa, Artificial Sequence; identical to SEQ ID NO: 11025
  hemagglutinin__InfluenzaA__AHG96947

SEQ ID NO: 11075 - protein, 566 aa, Artificial Sequence; identical to SEQ ID NO: 11025
  hemagglutinin__InfluenzaA__AHG96959

SEQ ID NO: 11076 - protein, 566 aa, Artificial Sequence; identical to SEQ ID NO: 11025
  hemagglutinin__InfluenzaA__AHG96971

SEQ ID NO: 11077 - protein, 566 aa, Artificial Sequence; identical to SEQ ID NO: 11025
  hemagglutinin__InfluenzaA__AHG96983

SEQ ID NO: 11078 - protein, 566 aa, Artificial Sequence; identical to SEQ ID NO: 11025
  hemagglutinin__InfluenzaA__AHG96995

SEQ ID NO: 11079 - protein, 566 aa, Artificial Sequence; identical to SEQ ID NO: 11025
  hemagglutinin__InfluenzaA__AHG97007

SEQ ID NO: 11080 - protein, 566 aa, Artificial Sequence; identical to SEQ ID NO: 11025
  hemagglutinin__InfluenzaA__AHG97019

SEQ ID NO: 11081 - protein, 566 aa, Artificial Sequence; identical to SEQ ID NO: 11025
  hemagglutinin__InfluenzaA__AHG97031

SEQ ID NO: 11082 - protein, 566 aa, Artificial Sequence; identical to SEQ ID NO: 11025
  hemagglutinin__InfluenzaA__AHG97043

SEQ ID NO: 11083 - protein, 566 aa, Artificial Sequence
  hemagglutinin__InfluenzaA__AHH00866
MKTIIALSYILCLAFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLENRYPALNVTMPNNDKFDKLYIWGVHHPSTDSDQISVYAQASGRVTVSTKRSQQTVIPNIGSRPWVRGISSRISIYWTIVNPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNKLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 11084 - protein, 566 aa, Artificial Sequence
  hemagglutinin__InfluenzaA__AHH00870
MKTIIALSYILCLAFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLENRYPALNVTMPNNDKFDKLYIWGVHHPSTDSDQISVYAQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNKLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 11085 - protein, 566 aa, Artificial Sequence
  hemagglutinin__InfluenzaA__AHJ57430
MKAILVVLLYTFATANADTLCIGYHANNSTDTVDTVLEKNVTVTHSVNLLEDKHNGKLCRLRGVAPLHLGKCNIAGWILGNPECESLSTASSWSYIVETSSSDNGTCYPGDFINYEELREQLSSVSSFERFEISPKTSSWPNHDSNKGVRAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAASGIIISDTPVHDCNTTCQTPKGAVNTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCNNTCMESVKNGTYDYPKYSEEAKLNREKIDGVKLESTRIYQILAIYSTVASSLVLVVSLGAISFWMCSNGSLQCRICI

SEQ ID NO: 11086 - protein, 566 aa, Artificial Sequence
  hemagglutinin__InfluenzaA__AHJ57431
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVRAACPHAGAKSFYKNLIWLVKKGNSYPKLSQSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11087 - protein, 566 aa, Artificial Sequence
  hemagglutinin__InfluenzaA__AHJ57432
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPQIAIRPKVRDQEGRMNYYWTLVEPGDKITFEATGNLVVPRYAFALERNAGSGIIISDTPVHDCNTTCQTPKGAINTSLPFQNIHPITIGKCPKYVKSTKLRLATGLRNVPSIQSRGLFGAIAGFIEGGWTGMVEGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11088 - protein, 566 aa, Artificial Sequence
  hemagglutinin__InfluenzaA__AHJ57433
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKEGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11089 - protein, 566 aa, Artificial Sequence
  hemagglutinin__InfluenzaA__AHJ57434
MKAILVVLLYTFATANADTLCIGYHANNSTDTVDTVLEKNVTVTHSVNPLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKEGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11090 - protein, 566 aa, Artificial Sequence
  hemagglutinin__InfluenzaA__AHJ57435
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNRGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11091 - protein, 566 aa, Artificial Sequence
  hemagglutinin__InfluenzaA__AHJ57436
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTIPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSELNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11092 - protein, 566 aa, Artificial Sequence
  hemagglutinin__InfluenzaA__AHJ57437
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLKENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11093 - protein, 566 aa, Artificial Sequence
  hemagglutinin__InfluenzaA__AHJ57438
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLKWLTHLNFKYPALNVTMPNNEQFDKLYIWGVHHPGTDKDQIFLYAQASGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGDCPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACTGSIRNGTYDHDVYRDEALNNRFQIKGVEVKSGYKDWILWISFAISCFLLCVALLGFIMWACQKGNIRCNICI

SEQ ID NO: 11094 - protein, 566 aa, Artificial Sequence
  hemagglutinin__InfluenzaA__AHJ57651
MIAFIVIAILAATGKSDKICIGYHANNSTTKVDTILEKNVTVTHSVELLENQKEERFCKISNKAPLDLRDCTLEGWILGNPRCGILLADQSWSYIVERPNARNGICYPGTLNEVEELKALIGSGERVERFEMFPKSTWAGVDTDSGVSSACPLGNGPSFYRNLLWIIKLKSSEYPVIRGTFNNTGDKSILYFWGVHHPPVTTEQEALYGSGDRYVRMGTESMNFARSPEIAARPAVNGQRGRIDYFWSILKPGETLNVESNGNLIAPWYAYRFVNKDSKGAIFRSTLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDMHDANVKILYEKVRSQLRDNAKDLGNGCFEFWHKCDNECIESVKNGTYNYPKYQSESRLNRQTIESVKLENLGVYQILAIYSTVSSSLVLVGLILAMGLWMCSNGSMQCRICI

SEQ ID NO: 11095 - protein, 566 aa, Artificial Sequence
  hemagglutinin__InfluenzaA__AHJ57663
MIAFIVIATLVATGKSDKICIGYHANNSTTKVDTILEKNVTVTHSVELLENQKEERFCKISNKAPLDLRDCTLEGWILGNPRCGILLADQSWSYIVERPNARNGICYPGTLNEAEELKALIGSGERVERFEMFPKSTWTGVDTESGVSSACPLGNGPSFYRNLLWIIKLKSSEYPVIRGTFNNTGDKSILYFWGVHHPPVTTEQNALYGSGDRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADKESTQKAIDGITNKVNSIIDKMNTQFEAVGHEFSNLERRIDNLNKRMEDGFLDVWTYNAELLVLLENERTLDLHDANVKNLHERVKSQLRDNANDLGNGCFEFWHKCDNECMESVKNGTYNYPKYQAESRLNKQKIESVKLEEFGVYQILAIYSTVSSSLVLVGLIMAMGLWMCPNGSMQCRICI

SEQ ID NO: 11096 - protein, 566 aa, Artificial Sequence
  hemagglutinin__InfluenzaA__AHJ57674
MIAFIVIAILVTTGKSDKICIGYHANNSTTKVDTILEKNVTVTHSVELLENQKEERFCKISNKAPLDLRDCTLEGWILGNPRCGILLADQSWSYIVERPNARNGICYPGTLNEVEELKALIGSGERVERFEMFPKSTWAGVDTNSGVSSACPLGEGPSFYRNLLWIIKHTTSGYPVIKGTYRNTGDKSVLYFWGVHHPPDTTEQNVLYGSGNRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHERVRSQLRDNANDLGNGCFEFWHKCDNECMESVKNGTYNYPKYQAESRLNRQKIESVKLEEFGVYQILAIYSTVSSSLVLVGLIMAMGLWMCSNGSMQCRICI

SEQ ID NO: 11097 - protein, 566 aa, Artificial Sequence
  hemagglutinin__InfluenzaA__AHJ57686
MIAFIVIAILAATGKSDKICIGYHANNSTTKVDTILEKNVTVTHSVELLENQKEGRFCKISNKAPLDLRDCTLEGWILGNPRCGILLADQSWSYIVERPNARNGICYPGILNEAEELKALIGSGERVERFEMFPKSTWAGVDTNSGVSSACPLGNGPSFYRNLLWIIKLKSSAYPVIRGTFNNTGDKSILYFWGVHHPPVATEQEALYGSGNRYVRMGTESMNFARNPEIAARPAVNGQRGRIDYFWSILKPGETLNVESNGNLIAPWYAYRFVNKDSKGAIFRSNLPIENCEATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCDNECMESVKNGTYDYPKYQAESRLNRQKIESVKLENFDVYQILAIYSTVSSSLVLVGLIMAMGLWMCSNGSMQCRICI

SEQ ID NO: 11098 - protein, 566 aa, Artificial Sequence
  hemagglutinin__InfluenzaA__AHJ57697
MIAFIVIAILAATGKSDKICIGYHANNSTTKVDTILEKNVTVTHSVELLENQKEERFCKISNKAPLDLRDCTLEGWILGNPRCGILLADQSWSYIVERPNARNGICYPGTLNEVEELKALIGSGERVERFEMFPKSTWAGVDTNSGVSSACPLGNGPSFYRNLLWIIKLKSSEYPVIRGTFNNTGDKSILYFWGVHHPPVTTEQEALYGSGDRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHEKVKSQLRDNANDLGNGCFEFWHKCDNECMESVKNGTYDYPKYQAESRLNRQKIESVKLENFDVYQILAIYSTVSSSLVLVGLIMAMGLWMCSNGSMQCRICI

SEQ ID NO: 11099 - protein, 566 aa, Artificial Sequence
  hemagglutinin__InfluenzaA__AHJ57707
MIAFIVIAILVTTGKSDKICVGYHANNSTTKVDTILEKNVTVTHSVELLENQKEERFCKISNKAPLDLRDCTLEGWILGNPRCGILLADQSWSYIVERPNARNGICYPGTLNEVEELKALIGSGERVERFEMFPKSTWTGVDTNSGVSSACPLGEGPSFYRNLLWIIKHTTSGYPVIKGTYRNTGDKSVLYFWGVHHPPDTTEQNVLYGSGNRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHERVRSQLRDNANDLGNGCFEFWHKCDNECMESVKNGTYNYPKYQAESRLNKQKIESVKLEEFGVYQILAIYSTVSSSLVLVGLIMAMGLWMCSNGSMQCRICI

SEQ ID NO: 11100 - protein, 566 aa, Artificial Sequence
  hemagglutinin__InfluenzaA__AHJ57719
MIAFIVIAILAATGKSDKICIGYHANNSTTKVDTILEKNVTVTHSVELLENQKEERFCKISNKAPLDLRDCTLEGWILGNPRCGILLSDQSWSYIVERPNARNGICYPGILNEAEELKALIGSGERVERFEMFPKSTWAGVDTNSGVSSACPLGNGPSFFRNLLWIIKLKSSTYPVIRGTFNNTGDKSILYFWGVHHPSVTTEQEALYGSGNRYVRMGTESMNFARSPEIAARPAVNGQRGRIDYFWSILKPGETLNVESNGNLIAPWYAYRFVNKDSKGAIFRSNLPIENCDATCQTIEGVIRTNKTFQNVSPLWIGECPKYVKSKSLRLATGLRNVPQIETRGLFGAIAGFIEGGWTGMIDGWYGYHHENSQGSGYADDKESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCDNECMESVKNGTYDYPKYQAESRLNRQKIESVKLENFDVYQILAIYSTVSSSLVLVGLIMAMGLWMCSNGSMQCRICI

SEQ ID NO: 11101 - protein, 566 aa, Artificial Sequence
  hemagglutinin__InfluenzaA__AHJ57731
MIAFIVIAILAATGKSDKICIGYHANNSTTKVDTILEKNVTVTHSVELLENQKEERFCKISNKAPLDLRDCTLEGWILGNPRCGILLADQSWSYIVERPNARNGICYPGILNEAEELKALIGSGERVERFEMFPKSTWAGVDTDSGVSSACPLGNGPSFYRNLLWIIKLKSSEYPVIRGTFNNTGDKSILYFWGVHHPPVTTEQEALYGSGNRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCDNECMESVKNGTYDYPKYQTESRLNRQKIESVKLENFDVYQILAIYSTVSSSLVLVGLIMAMGLWMCSNGSMQCRICI

SEQ ID NO: 11102 - protein, 566 aa, Artificial Sequence
  hemagglutinin__InfluenzaA__AHJ57743
MIAFIVIAILVATGKSDKICIGYHANNSTTKVDTILEKNVTVTHSVELLENQKEERFCKISNKAPLDLRDCTIEGWILGNPRCGILLADQSWSYIVERPDARNGICYPGTLNEAEELKALIGSGEKVERFEMFPKSTWAGVDTSSGVSSACPLGNGPSFYRNLLWIIKLKSSEYPVIRGTFNNTGDKSVLYFWGVHHPPVTTEQNALYGSGNRYVRMGTESMNFARSPEIAARPAVNGQRGRIDYFWSILKPGETLNVESNGNLIAPWYAYRFVNKDSKGAIFRSNLPIENCDATCQTIEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAAGHEFSNLERRIDNLNKRMEDGFLDVWTYNAELLVLLENERTLDLHDANVKNLHEKVKSQLRDNANDLGNGCFEFWHKCDNECMESVKNGTYDYPKYQKESRLNRQKIESVKLENFDVYQILAIYSTVSSSLVLVGLIMAMGLWMCSNGSMQCRICI

SEQ ID NO: 11103 - protein, 566 aa, Artificial Sequence
  hemagglutinin__InfluenzaA__AHJ57755
MIAFIVIAILVATGKSDKICIGYHANNSTTKVDTILEKNVTVTHSVELLENQKEERFCKISNKAPLDLRDCTIEGWILGNPRCDILLADQSWSYIVERPNARNGICYPGTLNEAEELKALIGSGEGVERFEMFPKSTWVGVDTSSGVSSACPLGNGPSFYRNLLWIIKLKSSEYPVIRGTFNNTGDKSVLYFWGVHHPPVTTEQNALYGSGNRYVRMGTESMNFARSPEIAARPAVNGQRGRIDYFWSILKPGETLNVESNGNLIAPWYAYRFVNKDNKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAAGHEFSNLERRIDNLNKRMEDGFLDVWTYNAELLVLLENERTLDLHDANVKNLHEKVKSQLRDNANDLGNGCFEFWHKCDNECMESVKNGTYDYPKYQKESRLNRQKIESVKLENFDVYQILAIYSTVSSSLVVVGLIMAMGLWMCSNGSMQCRICI

SEQ ID NO: 11104 - protein, 566 aa, Artificial Sequence
  hemagglutinin__InfluenzaA__AHJ57767
MIAFIVIAILAATGKSDKICIGYHANNSTTKVDTILEKNVTVTHSVELLENQKEERFCKISNKAPLDLRDCTLEGWILGNPRCGILLADQSWSYIVERPNARNGICYPGTLNEVEELKALIGSGERVERFEMFPKSTWAGVDTNSGVSSACPLGNGPSFYRNLLWIIKLKSSEYPVIRGTFNNTGDKSILYFWGVHHPPVTTEQEALYGSGDRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHESSQGSGYAADKESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCNNECMESVKNGTYDYPKYQKESRLNRQKIESVKLENFDVYQILAIYSTVSSSLVLVGLILAMGLWMCSNGSMQCRICI

SEQ ID NO: 11105 - protein, 566 aa, Artificial Sequence
  hemagglutinin__InfluenzaA__AHJ57779
MIAIIIIAILVATGKSDKICIGYHANNSTTKVDTILEKNVTVTHSVELLEDQKEERFCKISNKAPLDLRDCTIEGWILGNPRCGILLADQSWSYIVERPNARNGICYPGTLNEAEELKALIGSGEGVERFEMFPKSTWAGVDTNSGVSSACPLGNGPSFYRNLLWIIKLKSSEYPVIRGTFNNTGDKSVLYFWGVHHPPVTTEQNALYGSGNRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAAGHEFSNLERRIDNLNKRMEDGFLDVWTYNAELLVLLENERTLDLHDANVKNLHEKVKSQLRDNANDLGNGCFEFWHKCDNECMESVKNGTYDYPKYQKESRLNRQKIESVKLENFDVYQILAIYSTVSSSLVLVGLIMAMGLWMCSNGSMQCMICI

SEQ ID NO: 11106 - protein, 566 aa, Artificial Sequence
  hemagglutinin__InfluenzaA__AHJ57791
MIAIIIIAILVTTGKSDKICIGYHANNSTTKVDTILEKNVTVTHSVELLENKKEERFCKISNKAPLDLRDCTLEGWILGNPRCGILLADQSWSYIVERPNARNGICYPGTLNEVKELKALIGSGERVKRFEMFPKSTWAGVDTNSGVSSSCPLGNGPSFYRNLLWIIKHTTSGYPVIKGTYTNTGDKSVLYFWGIHHPPDTTEQNVLYGSGNRYVRMGTESMNFARSPEIAARPAVNGQRGRIDYFWSILKPGETLNVESNGNLIAPWYAYRFVNKDSKGAIFRSNLPIEDCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDTLNKRMEDGFLDVWTYNAELLVLLENERTLDLHDANVKNLHERVKSQLRDNANDLGNGCFEFWHKCDNECMESVKNGTYNYPKYQAESRLNKQKIESVKLEEFGVYQILAIYSTVSSSLVLVGLIMAMVLWMCSNGSMQCRVCI

SEQ ID NO: 11107 - protein, 566 aa, Artificial Sequence
  hemagglutinin__InfluenzaA__AHJ57815
MIAFIIITILVTTGKSDKICIGYHANNSTTKVDTILEKNVTVTHSVELLENQKEERFCRISNKAPLDLKECTLEGWILGNPQCDLLLGDQSWSYIVERPNARNGICYPGTLNEVEELRALIGSGEGVERFEMFPKSTWAGVDTNRGVTSSCPFGSGSSFYRNLLWIVKHTTSSYPVIKGTFRNTGDKSVLYFWGVHHPFDTNEQNVLYGSGNRYVRMGTESMNFARGPEVAARPVVNGQRGRIDYFWSILKPGETLNIESNGNLIAPWYAYRFVNKDSKGAIFRSNLPIEDCDATCQTIEGVIRTNKTFQNVSPLWIGECPKYVKSESLRLATGLRNVPQIETRGLFGAIAGFIEGGWTGMIDGWYGYHHENSQGSGYAADRESTQKAIDGITTKVNSIIDKMNTQFEAVGHEFSNLERRIDNLNKRLEDGFLDVWTYNAELLVLLENERTLDLHDANVKNLHERVRSQLRDNANDLGNGCFEFWHKCDNECMESVKNGTYNYPKYQAESRLNKQRIESVKLENFDVYQILAIYSTVSSSLVLVGLILAMGLWMCSNGSMQCRICI

SEQ ID NO: 11108 - protein, 566 aa, Artificial Sequence
  hemagglutinin__InfluenzaA__AHJ57827
MIAFIVIAILVATGKSDKICIGYHANNSTTKVDTILEKNVTVTHSVELLENQKEERFCKISNKAPLDLRDCTIEGWILGNPRCGILLADQSWSYIVERPNARNGICYPGTLNEVEELKALIGSGERVERFEMFPKSTWAGVDTNSGVSSACPLGNGPSFYRNLLWIIKTKSSEYPVIKGTFNNTGDKSVLYFWGVHHPPSRNEQNVLYGSGDRYVRMGTESMNFARSPEIAARPAVNGQRGRIDYFWSILKPGETLNVESNGNLIAPWYAYRFVNKDSRGAIFRSNLPIENCDATCQTAEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHERVKSQLRDNANDLGNGCFEFWHKCDNECMESVKNGTYDYPKYQKESRLNRQKIESVKLENFDVYQILAIYSTVSSSLVLVGLIMAMGLWMCSNGSMQCRICI

SEQ ID NO: 11109 - protein, 566 aa, Artificial Sequence
  hemagglutinin__InfluenzaA__AHJ57850
MIAFIVIAILATTGKSDKICIGYHANNSTTKVDTILEKNVTVTHSVELLENQKEERFCKISNKAPLDLRDCTLEGWILGNPRCGILLADQSWSYIVERPNARNGICYPGILNEAEELKALIGSGERVERFEMFPKSTWAGVDTDSGVSSACPLGNGPSFYRNLLWIIKLKSSEYPVIRGTFNNTGDKSILYFWGVHHPPVTTEQEALYGSGNRYVRMGTESMNFARTPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCDNECMESVKNGTYDYPKYQAESRLNRQKIESVKLENFDVYQILAIYSTVSSSLVLVGLIMAMGLWMCSNGSMQCRICI

SEQ ID NO: 11110 - protein, 566 aa, Artificial Sequence
  hemagglutinin__InfluenzaA__AHJ57862
MIAFIVIAILAATGKSDKICIGYHANNSTTKVDTILEKNVTVTHSVELLENQKEERFCKISNKAPLDLRDCTLEGWILGNPRCGILLADQSWSYIVERPNARNGICYPGILNEAEELKALIGSGERVERFEMFPKSTWAGVDTNSGVSSACPLGNGPSFYRNLLWIIKLKSSEYPVIRGTFNNTGDKSILYFWGVHHPPVTTEQEALYGSGNRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCDNECMESVKNGTYDYPKYQAESRLNRQKIESVKLENFDVYQILAIYSTVSSSLVLVGLIMAMGLWMCSNGSMQCRICI

SEQ ID NO: 11111 - protein, 566 aa, Artificial Sequence
  hemagglutinin__InfluenzaA__AHJ57873
MIAFIVIATLVATGKSDKICMGYHANNSTTKVDTILEKNVTVTHSVELLENQKEERFCKISNKAPLDLRDCTLEGWILGNPRCGILLADQSWSYIVERPNARNGICYPGTLNEAEELKALIGSGERVERFEMFPKSTWTGVDTESGVSSACPLGNGPSFYRNLLWIIKLKSSEYPVIRGTFNNTGDKSILYFWGVHHPPVTTEQNALYGSGDRYVRMGTESMNFARSPEIAARPAVNGQRGRIDYFWSILTPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADKESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCDNECMESVKNGTYDYPKYQKESRLNRQKIESVKLENFDVYQILAIYSTVSSSLVLVGLILAMGLWMCSNGSMHCRICI

SEQ ID NO: 11112 - protein, 566 aa, Artificial Sequence
  hemagglutinin__InfluenzaA__AHJ57885
MIAFIVMAILAATGKSDKICIGYHANNSTTKVDTILEKNVTVTHSVELLENQKEERFCKISNKAPLDLRDCTLEGWILGNPRCGILLADQSWSYIVERPNARNGICYPGILNEAEELKALIGSGERVERFEMFPKSTWAGVDTDSGVSSACPLGNGPSFYRNLLWIIKRKSSAYPVIRGTFNNTGDKSILYFWGVHHPPVTTEQEALYGSGNRYVRMGTESMNFARNPEIAARPAVNGQRGRIDYFWSILKPGETLNIESNGNLIAPWYAYRFVNKDSKGAIFRSNLPIEDCDASCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLDKRMEDGFLDVWTYNAELLVLLENERTLDLHDANVKNLHEKVRSQLRDNANDLGNGCFEFWHKCDNECMESVKNGTYDYPKYQAESRLNRQKIESVKLENFDVYQILAIYSTVSSSLVLVGLIMAMGLWMCSNGSMQCRICI

SEQ ID NO: 11113 - protein, 566 aa, Artificial Sequence
  hemagglutinin__InfluenzaA__AHJ57897
MIAFIVIAILAATGKSDKICIGYHANNSTTKVDTILEKNVTVTHSVELLENQKEERFCKISNKAPLDLRDCTLEGWILGNPRCGILLADQSWSYIVERPNARNGICYPGILNEAEELKALIGSGERVERFEMFPKSTWAGVDTDSGVSSACPLGNGPSFYRNLLWIIKRKSSAYPVIRGTFNNTGDKSILYFWGVHHPPVTTEQEALYGSGNRYVRMGTESMNFARNPEIAARPAVNGQRGRIDYFWSILKPGETLNIESNGNLIAPWYAYRFVNKDSKGAIFRSNLPIEDCDASCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCDNECMESVKNGTYDYPKYQAESRLNRQKIESVKLENFDVYQILAIYSTVSSSLVLVGLIMAMGLWMCSNGSMQCRICI

SEQ ID NO: 11114 - protein, 566 aa, Artificial Sequence
  hemagglutinin__InfluenzaA__AHJ57908
MIAFIVIAILVATGKSDKICIGYHANNSTTKVDTILEKNVTVTHSVELLENQKEERFCKISNKAPLDLRDCTVEGWILGNPRCGILIADQSWSYIVERPNARNGICYPGTLNEAEELKALIGSGEGVERFEMFPKSTWAGVDTSSGVSSACPLGNGPSFYRNLLWIIKLKSSEYPVIRGTFNNTGDKSVLYFWGVHHPPVTTEQDALYGSGNRYVRMGTESMNFARSPEIAARPAVNGQRGRIDYFWSVLKPGETLNVESNGNLIAPWYAYRFVNKDNKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAAGHEFSNLERRIDNLNKRMEDGFLDVWTYNAELLVLLENERTLDLHDANVKNLHEKVKSQLRDNANDLGNGCFEFWHKCDNECMESVKNGTYDYPKYQKESRLNRQRIESVKLENFDVYQILAIYSTVSSSLVVVGLIMAMGLWMCSNGSMQCMICI

SEQ ID NO: 11115 - protein, 566 aa, Artificial Sequence
  hemagglutinin__InfluenzaA__AHJ57920
MIAIIIIAILVATGKSDKICIGYHANNSTTKVDTILEKNVTVTHSVELLENQKEERFCKISNKAPLDLRDCTIEGWILGNPWCGILLADQSWSYIVERPNARNGICYPGTLNEVEELKALIGSGERVERFEMFPKSTWAGVDTNSGVSSACPLGNGPSFYRNLLWIIKTKSSEYPVIKGTFNNTGDKSVLYFWGVHHPPSRNEQNVLYGSGDRYVRMGTESMNFARSPEIAARPAVNGQRGRIDYFWSILKPGETLNVESNGNLIAPWYAYRFVNKDSRGAIFRSNLPIENCDATCQTAEGVIRTNKTFQNVSPLWIGECPKYVKSKSLRLATGLRNVPQIETRGLFGAIAGFIEGGWTGMIDGWYGYHHENSQGSGYAADRESTQKATDGITNKVNSIIDKMNTQFEAVGHEFSNLERRIDNLNKRMEDGFLDVWTYNAELLVLLENERTLDLHDANVKNLHERVKSQLRDNANDLGNGCFEFWHKCDNECMESVKNDTYDYPKYQKESRLNRQKIESVRLENFDVYQILAIYSTVSSSLVLVGLIMAMGLWMCSNGSMQCRICI

SEQ ID NO: 11116 - protein, 566 aa, Artificial Sequence
  hemagglutinin__InfluenzaA__AHJ57932
MIALIIITILVTTGKSDKICIGYHANNSTTKVDTILEKNVTVTHSVELLENQKEERFCRISNKAPLDLKECTLEGWILGNPQCDLLLGDQSWSYIVERPNARNGICYPGTLNEVEELRALIGSGEGVERFEMFPKSTWAGVDTNRGVTSSCPFGSGSSFYRNLLWIVKHTTSSYPVIKGTFRNTGDKSVLYFWGVHHPFDTNEQNVLYGSGNRYVRMGTESMNFARGPEVAARPVVNGQRGRIDYFWSILKPGETLNIESNGNLIAPWYAYRFVNKDSKGAIFRSNLPIEDCDATCQTIEGVIRTNKTFQNVSPLWIGECPKYVKSESLRLATGLRNVPQIETRGLFGAIAGFIEGGWTGMIDGWYGYHHENSQGSGYAADRESTQKAIDGITTKVNSIIDKMNTQFEAVGHEFSNLERRIDNLNKRLEDGFLDVWTYNAELLVLLENERTLDLHDANVKNLHERVRSQLRDNANDLGNGCFEFWHKCDNECMESVRNGTYNYPKYQAESRLNKQRIESVKLENFDVYQILAIYSTVSSSLVLVGLILAMGLWMCSNGSMQCRICI

SEQ ID NO: 11117 - protein, 566 aa, Artificial Sequence
  hemagglutinin__InfluenzaA__AHJ57943
MIAFIVIATLVATGKSDKICIGYHANNSTTKVDTILEKNVTVTHSVELLENQKEERFCKISNKAPLDLRDCTLEGWILGNPRCGILLADQSWSYIVERPNARNGICYPGTLNEAEELKALIGSGERVERFEMFPKSTWTGVDTESGVSSACPLGNGPSFYRNLLWIIKLKSSEYPVIRGTFNNTGDKSILYFWGVHHPPVTTEQNALYGSGDRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADKESTQKAIDGITNKVNSIIDKMNTQFETVGHEFSNLERRIDNLNKRMEDGFLDVWTYNAELLVLLENERTLDLHDANVKNLHEKVRSQLRDNANDLGNGCFEFWHKCNNECMESVKNGTYDYPKYQKESRLNRQKIESVKLENFDVYQILAIYSTVSSSLVLVGLILAMGLWMCSNGSMQCRICI

SEQ ID NO: 11118 - protein, 566 aa, Artificial Sequence
  hemagglutinin__InfluenzaA__AHJ57954
MIAFIVIAILAATGKSDKICIGYHANNSTTKVDTILEKNVTVTHSVELLENQKEERFCKISNKAPLDLRDCTLEGWILGNPRCGILLADQSWSYIVERPNARNGICYPGILNEAEELKALIGSGERVERFEMFPKSTWAGVDTNSGVSSACPLGNGPSFYRNLLWIIKQKSSAYPVIRGTFNNTGDKSILYFWGVHHPPVTTEQEALYGSGNRYVRMGTESMNFARNPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCDNECMESVKNGTYDYPKYQAESRLNRQKIESVKLENFDVYQILAIYSTVSSSLVLVGLIMAMGLWMCSNGSMQCRICI

SEQ ID NO: 11119 - protein, 566 aa, Artificial Sequence
  hemagglutinin__InfluenzaA__AHJ57965
MIAFIIITILVTTGKSDKICIGYHANNSTTKVDTILEKNVTVTHSVELLENQKEERFCKISNKAPLDLKECTLEGWILGNPQCDLLLGDQSWSYIVERPNARNGICYPGTLNEVEELKALIGSGERVERFEMFPKSTWAGVDTNSGVTSSCSFGSGSSFYRNLLWIIKHTTSSYPVIKGTFRNTGDKSVLYFWGVHHPIDTTEQNVLYGSGNRYVRMGTESMNFARSPEIAARPVVNGQRGRIDYFWSILKPGETLNIESNGNLIAPWYAYRFVNKDSKGAIFRSNLPIENCDATCQTIEGVIRTNKTFQNVSPLWIGECPKYVKSESLRLATGLRNVPQIETRGLFGAIAGFIEGGWTGMIDGWYGYHHENSQGSGYAADRESTQRAIDGITTKVNSIIDKMNTQFEAVGHEFSNLERRIDNLNKRMEDGFLDVWTYNAELLVLLENERTLDLHDANVKNLHERVRSQLRDNANDGGNGCFEFWHKCDNECMESVKNGTYDYPKYQAESRSNRQRIESVKLENFDVYQILAIYSTVSSSLVVVWLILAMGLWMCANGSMQCRICI

SEQ ID NO: 11120 - protein, 566 aa, Artificial Sequence
  hemagglutinin__InfluenzaA__AHJ57977
MIAFIVIAILAATGKSDKICIGYHANNSTTKVDTILEKNVTVTHSVELLENQKEERFCKISNKAPLDLRDCTIEGWILGNPRCGILLADQSWSYIVERPNARNGICYPGTLNEVEELKALIGSGERVERFEMFPKSTWAGVDTNSGVSSACPLGNGPSFYRNLLWIIKLKSSEYPVIRGTFNNTGDKSILYFWGVHHPPVTTEQEALYGSGDRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADKESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCNNECMESVKNGTYDYPKYQKESRLNRQKIESVKLENFDVYQILAIYSTVSSSLVLVGLILAMGLWMCSNGSMQCRICI

SEQ ID NO: 11121 - protein, 566 aa, Artificial Sequence
  hemagglutinin__InfluenzaA__AHJ57989
MIAFIVIAILVTTGKSDKICIGYHANNSTTKVDTILEKNVTVTHSVELLENQKEERFCKISNKAPLDLRDCTLEGWILGNPRCGILLADQSWSYIVERPNARNGICYPGTLNEVEELKALIGSGERVERFEMFPKSTWARVDTDRGVSSACPLGNGPSFYRNLLWIVKHTTSEYPVIKGTYTNTGDKSVLYFWGVHHPPDTTEQNVLYGSGNRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPMWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDSNVKNLHERVKSQLRDNANDLGNGCFEFWHKCDNECMESVKNGTYNYPKYQAESRLNRQKIESVKLEEFGVYQILAIYSTVSSSLVLVGLIMAMGLWMCSNGSMQCRICI

SEQ ID NO: 11122 - protein, 566 aa, Artificial Sequence
  hemagglutinin__InfluenzaA__AHJ58001
MIAFIVIAILAATGKSDKICIGYHANNSTTKVDTILEKNVTVTHSVELLENQKEERFCKISNKAPLDLRDCTLEGWILGNPRCGILLADQSWSYIVERPNARNGICYPGILNEAEELKALIGSGERVERFEMFPKSTWAGVDTDSGVSSACPLGNGPSFYRNLLWIIKLKSSEYPVIRGTFNNTGDKSILYFWGVHHPPVTTEQEALYGSGNRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPMWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCDNECMESVKNGTYDYPKYQTESRLNRQKIESVKLENFDVYQILAIYSTVSSSLVLVGLIMAMGLWMCSNGSMQCRICI

SEQ ID NO: 11123 - protein, 566 aa, Artificial Sequence
  hemagglutinin__InfluenzaA__AHJ58013
MIAFIVIAILVTTGKSDKICIGYHANNSTTKVDTILEKNVTVTHSVELLENQKEERFCKISSKAPLDLRDCSLEGWILGNPRCGILLADQSWSYIVERPNARNGICYPGTLNEVEELKALIGSGERVERFEMFPKSTWAGVDTNSGVSSACPLGEGPSFYRNLLWIIKRTTSEYPVIKGTYRNTGDKSVLYFWGVHHPPDTTEQNVLYGSGNRYVRMGTESMNFARSPEIAARPAVNGQRGRIDYFWSILKPGETLDVESNGNLIAPWYAYRFVNKESKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADKESTQKAIDGITNKVNSIIDKMNTQFEAVGHEFSTLERRIDNLNKRMEDGFLDVWTYNAELLVLLENERTLDLHDANVKNLHERVRSQLRDNANDLGNGCFEFWHKCDNECMESVKNGTYNYPKYQAESRLNKQKIESVKLEEFGVYQILAIYSTVSSSLVLVGLIMAMGLWMCSNGSMQCRICI

SEQ ID NO: 11124 - protein, 566 aa, Artificial Sequence
  hemagglutinin__InfluenzaA__AHJ58025
MIAFIVIAILVTTGESDKICIGYHANNSTTKVDTILEKNVTVTHSVELLENQKEERFCKISNKAPLDLRDCTIEGWILGNPRCGILLADQSWSYIVERPNARNGICYPGTLNEAEELKALIGSGEGVERFEMFPKSTWAGVDTNSGVSSACPLGNGPSFYRNLLWIIKLKSSEYPVIRGTFNNTGDKSVLYFWGVHHPPVTTEQNDLYGSGNRYVRMGTESMNFARNPEIALRPAVNGQRGRIDYFWSILKPGETLNVESNGNLIAPWYAYRFVNKDSKGAIFRSSLPIENCDATCQTAEGVIRTNKTFQNVSPLWIGECPKYVKSKSLRLATGLRNVPQIETRGLFGAIAGFIEGGWTGMVDGWYGYHHENSQGSGYAADRESTQKAIDGITNKVNSIIDKMNTQFEAVDHEFSNLERRIDNLNKRMEDGFLDVWTYNAELLVLLENERTLDLHDANVKNLHEKVKSQLRDNANDLGNGCFEFWHKCDNECMESVKNGTYNYPKYQKESRLNRQKIESVKLENFDVYQILAIYSTVSSSLVLVGLIMAMGLWMCSNGSMQCRICI

SEQ ID NO: 11125 - protein, 566 aa, Artificial Sequence
  hemagglutinin__InfluenzaA__AHJ58037
MIAFIIITILVTTGESDKICIGYHANNSTTKVDTILEKNVTVTHSVELLENQKEERFCKISNKAPLDLKECTLEGWILGNPQCDLLLGDQSWSYIVERPNARNGICYPGTLNEVEELKALIGSGERVERFEMFPKSTWAGVDTNSGVTRSCPFGSGSSFYRNLLWIIKHTTSSYPVIKGTFRNTGDKSVLYFWGVHHPIDTTEQNVLYGSGNRYVRMGTESMNFARSPEIAARPVVNGQRGRIDYFWSILKPGETLNIESNGNLIAPWYAYRFVNKDSKGAIFRSNLPIENCDATCQTIEGVIRTNKTFQNVSPLWIGECPKYVKSESLRLATGLRNVPQIETRGLFGAIAGFIEGGWTGMIDGWYGYHHENSQGSGYAADRESTQRAIDGITTKVNSIIDKMNTQFEAVGHEFSNLERRIDNLNKRMEDGFLDVWTYNAELLVLLENERTLDLHDANVKNLHERVKSQLRDNANDLGNGCFEFWHKCDNECMESVKNGTYDYPKYQAESRLNKQRIESVKLENFDVYQILAIYSTVSSSLVLVGLIMAIGLWMCSNGSMQCRICI

SEQ ID NO: 11126 - protein, 566 aa, Artificial Sequence
  hemagglutinin__InfluenzaA__AHJ58049
MIAFIVIAILAATGKSDKICIGYHANNSTTKVDTILEKNVTVTHSVELLENQKEERFCKISNKAPLDLRDCTLEGWILGNPRCGILLADQSWSYIVERPNARNGICYPGILNEAEELKALIGSGERVERFEMFPKSTWAGVDTDSGVSSACPLGNGPSFYRNLLWIIKLKSSEYPVIRGTFNNTGDKSILYFWGVHHPPVTTEQEALYGSGNRYVRMGTESMNFARTPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADRESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCDNECMESVKNGTYDYPKYQAESRLNRQKIESVKLENFDVYQILAIYSTVSSSLVLVGLIMAMGLWMCSNGSMQCRICI

SEQ ID NO: 11127 - protein, 566 aa, Artificial Sequence
  hemagglutinin__InfluenzaA__AHJ58061
MIAFIVIATLVATGKSDKICIGYHANNSTTKVDTILEKNVTVTHSVELLENQKEERFCKISNKAPLDLRDCTLEGWILGNPRCGILLADQSWSYIVERPNARNGICYPGTLNEAEELKALIGSGERVERFEMFPKSTWTGVDTESGVSSACPLGNGPSFYRNLLWIIKLKSSEYPVIRGTFNNTGDKSILYFWGVHHPPVTTEQNALYGSGDRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADKESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCNNECMESVKNGTYDYPKYQKESRLNRQKIESVKLENFDVYQILAIYSTVSSSLVLVGLILAMGLWMCSNGSMQCRICI

SEQ ID NO: 11128 - protein, 566 aa, Artificial Sequence
  hemagglutinin__InfluenzaA__AHJ58084
MIAFIVIATLVATGKSDKICIGYHANNSTTKVDTILEKNVTVTHSVELLENQKEERFCKISNKAPLDLRDCTLEGWILGNPRCGILLADQSWSYIVERPNARNGICYPGTLNEAEELKALIGSGERVERFEMFPKSTWTGVNTESGVSSACPLGNGPSFYRNLLWIIKLKSSEYPVIRGTFNNTGDKSILYFWGVHHPPVTTEQNALYGSGDRYVRMGTESMNFARSPEIAARPAVNGQRGRIDYFWSILKPGETLNVESNGNLIAPWYAYRFVNKDSKGAIFRSNLPIENCDATCQTTEGVIRTNKTFQNVSPLWIGECPKYVKSKSLRLATGLRNVPQIETRGLFGAIAGFIEGGWTGMIDGWYGYHHENSQGSGYAADKESTQKAIDGITNKVNSIIDKMNTQFEAVGHEFSNLERRIDNLNKRMEDGFLDVWTYNAELLVLLENERTLDLHDANVKNLHEKVRSQLRDNANDLGNGCFEFWHKCNNECMESVKNGTYDYPKYQKESRLNRQKIESVKLENFDVYQILAIYSTVSSSLVLVGLILAMGLWMCSNGSMQCRICI

SEQ ID NO: 11129 - protein, 566 aa, Artificial Sequence; identical to SEQ ID NO: 6855
  hemagglutinin__InfluenzaA__AHL80708

SEQ ID NO: 11130 - protein, 566 aa, Artificial Sequence
  hemagglutinin__InfluenzaA__AHL80718
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKISSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11131 - protein, 569 aa, Artificial Sequence
  hemagglutinin__InfluenzaA__AHL80729
MKAILVVLLYTFATANADTLCIGYHANNSTDTVDTVLEKNVTVTHSVNLLEDKHNGKLCKLRGVAPLHLGECNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11132 - protein, 566 aa, Artificial Sequence
  hemagglutinin__InfluenzaA__AHL80740
MKAILVVLLYTFATANADTLCIGYHANNSTDTVDTVLEKNVTVTHSVNLLEDKHNGKLCKLRGVAPLHLGKCNIAGWILGNPECELLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGVHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11133 - protein, 566 aa, Artificial Sequence
  hemagglutinin__InfluenzaA__AHL80751
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11134 - protein, 566 aa, Artificial Sequence
  hemagglutinin__InfluenzaA__AHL80762
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWILVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKDNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11135 - protein, 566 aa, Artificial Sequence
  hemagglutinin__InfluenzaA__AHL80784
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGITAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11136 - protein, 566 aa, Artificial Sequence; identical to SEQ ID NO: 3833
  hemagglutinin__InfluenzaA__AHL80795

SEQ ID NO: 11137 - protein, 566 aa, Artificial Sequence
  hemagglutinin__InfluenzaA__AHL80817
MKAILVVLLYTFATANADTLCIGYHANNSTDTVDTVLEKNVTVTHSVNLLEDKHNGKLCKLRGVAPLHLGNCNIAGWILGNPECESLSTASSWSYIVEASSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11138 - protein, 566 aa, Artificial Sequence; identical to SEQ ID NO: 11137
  hemagglutinin__InfluenzaA__AHL80828

SEQ ID NO: 11139 - protein, 566 aa, Artificial Sequence
  hemagglutinin__InfluenzaA__AHL80839
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGITAACPHAGAKSFYKNLIWLVKKGNSYPKLSRSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11140 - protein, 566 aa, Artificial Sequence
  hemagglutinin__InfluenzaA__AHL80861
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIGNLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11141 - protein, 566 aa, Artificial Sequence
  hemagglutinin__InfluenzaA__AHL80872
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTNADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11142 - protein, 566 aa, Artificial Sequence; identical to SEQ ID NO: 3833
  hemagglutinin__InfluenzaA__AHL80883

SEQ ID NO: 11143 - protein, 566 aa, Artificial Sequence; identical to SEQ ID NO: 3833
  hemagglutinin__InfluenzaA__AHL80894

SEQ ID NO: 11144 - protein, 566 aa, Artificial Sequence; identical to SEQ ID NO: 3833
  hemagglutinin__InfluenzaA__AHL80905

SEQ ID NO: 11145 - protein, 566 aa, Artificial Sequence; identical to SEQ ID NO: 6454
  hemagglutinin__InfluenzaA__AHL80916

SEQ ID NO: 11146 - protein, 566 aa, Artificial Sequence; identical to SEQ ID NO: 6855
  hemagglutinin__InfluenzaA__AHL80927

SEQ ID NO: 11147 - protein, 566 aa, Artificial Sequence; identical to SEQ ID NO: 6855
  hemagglutinin__InfluenzaA__AHL80946

SEQ ID NO: 11148 - protein, 566 aa, Artificial Sequence
  hemagglutinin__InfluenzaA__AHL80958
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKISSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11149 - protein, 566 aa, Artificial Sequence
  hemagglutinin__InfluenzaA__AHL81001
MKTIIALSYILCLIFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11150 - protein, 566 aa, Artificial Sequence; identical to SEQ ID NO: 6855
  hemagglutinin__InfluenzaA__AHL81013

SEQ ID NO: 11151 - protein, 566 aa, Artificial Sequence; identical to SEQ ID NO: 6855
  hemagglutinin__InfluenzaA__AHL81025

SEQ ID NO: 11152 - protein, 566 aa, Artificial Sequence; identical to SEQ ID NO: 6855
  hemagglutinin__InfluenzaA__AHL81037

SEQ ID NO: 11153 - protein, 566 aa, Artificial Sequence; identical to SEQ ID NO: 6855
  hemagglutinin__InfluenzaA__AHL81049

SEQ ID NO: 11154 - protein, 566 aa, Artificial Sequence; identical to SEQ ID NO: 11148
  hemagglutinin__InfluenzaA__AHL81061

SEQ ID NO: 11155 - protein, 566 aa, Artificial Sequence; identical to SEQ ID NO: 11148
  hemagglutinin__InfluenzaA__AHL81072

SEQ ID NO: 11156 - protein, 566 aa, Artificial Sequence; identical to SEQ ID NO: 8361
  hemagglutinin__InfluenzaA__AHL81083

SEQ ID NO: 11157 - protein, 566 aa, Artificial Sequence; identical to SEQ ID NO: 6855
  hemagglutinin__InfluenzaA__AHL81095

SEQ ID NO: 11158 - protein, 566 aa, Artificial Sequence
  hemagglutinin__InfluenzaA__AHL81118
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTNSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11159 - protein, 566 aa, Artificial Sequence; identical to SEQ ID NO: 6855
  hemagglutinin__InfluenzaA__AHL81129

SEQ ID NO: 11160 - protein, 566 aa, Artificial Sequence; identical to SEQ ID NO: 6855
  hemagglutinin__InfluenzaA__AHL81141

SEQ ID NO: 11161 - protein, 566 aa, Artificial Sequence; identical to SEQ ID NO: 6855
  hemagglutinin__InfluenzaA__AHL81153

SEQ ID NO: 11162 - protein, 566 aa, Artificial Sequence
  hemagglutinin__InfluenzaA__AHL81165
MKTIIALSYILCLVFAQKLPGNDNSTATLCLGHHAVPNGTIVKTITNDQIEVTNATELVQSSSAGEICDSPHQILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11163 - protein, 566 aa, Artificial Sequence; identical to SEQ ID NO: 11162
  hemagglutinin__InfluenzaA__AHL81177

SEQ ID NO: 11164 - protein, 566 aa, Artificial Sequence; identical to SEQ ID NO: 11149
  hemagglutinin__InfluenzaA__AHL81189

SEQ ID NO: 11165 - protein, 566 aa, Artificial Sequence
  hemagglutinin__InfluenzaA__AHL81212
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFKNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11166 - protein, 566 aa, Artificial Sequence
  hemagglutinin__InfluenzaA__AHL81224
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERTAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11167 - protein, 566 aa, Artificial Sequence; identical to SEQ ID NO: 6855
  hemagglutinin__InfluenzaA__AHL81235

SEQ ID NO: 11168 - protein, 566 aa, Artificial Sequence; identical to SEQ ID NO: 6855
  hemagglutinin__InfluenzaA__AHL81247

SEQ ID NO: 11169 - protein, 566 aa, Artificial Sequence; identical to SEQ ID NO: 6855
  hemagglutinin__InfluenzaA__AHL81259

SEQ ID NO: 11170 - protein, 566 aa, Artificial Sequence; identical to SEQ ID NO: 6855
  hemagglutinin__InfluenzaA__AHL81271

SEQ ID NO: 11171 - protein, 566 aa, Artificial Sequence; identical to SEQ ID NO: 6855
  hemagglutinin__InfluenzaA__AHL81283

SEQ ID NO: 11172 - protein, 566 aa, Artificial Sequence; identical to SEQ ID NO: 6855
  hemagglutinin__InfluenzaA__AHL81295

SEQ ID NO: 11173 - protein, 566 aa, Artificial Sequence; identical to SEQ ID NO: 11148
  hemagglutinin__InfluenzaA__AHL81307

SEQ ID NO: 11174 - protein, 566 aa, Artificial Sequence; identical to SEQ ID NO: 6867
  hemagglutinin__InfluenzaA__AHL81329

SEQ ID NO: 11175 - protein, 566 aa, Artificial Sequence
  hemagglutinin__InfluenzaA__AHL81340
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQDGTSSACIRGSKNSFFSRLNWLTHLNFKYPALNVTMPNNEQFDKLYIWGVHHPGTDKDQIFLYAQASGRITVSTKRSQQAAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNKRFQIKGIELKSGYKDWILWISFAISCFLLCVALLGFIMWACQKGNIRCNICI

SEQ ID NO: 11176 - protein, 566 aa, Artificial Sequence; identical to SEQ ID NO: 6855
  hemagglutinin__InfluenzaA__AHL81352

SEQ ID NO: 11177 - protein, 566 aa, Artificial Sequence
  hemagglutinin__InfluenzaA__AHL81364
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGACYPGDFINYEELREQLSSVSSFERFEIFPKTNSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11178 - protein, 566 aa, Artificial Sequence
  hemagglutinin__InfluenzaA__AHL81386
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTNSWPNHDSNKGVTAACPHAGVKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11179 - protein, 566 aa, Artificial Sequence; identical to SEQ ID NO: 6855
  hemagglutinin__InfluenzaA__AHL81397

SEQ ID NO: 11180 - protein, 566 aa, Artificial Sequence; identical to SEQ ID NO: 11165
  hemagglutinin__InfluenzaA__AHL81409

SEQ ID NO: 11181 - protein, 566 aa, Artificial Sequence; identical to SEQ ID NO: 11135
  hemagglutinin__InfluenzaA__AHL81419

SEQ ID NO: 11182 - protein, 566 aa, Artificial Sequence; identical to SEQ ID NO: 3833
  hemagglutinin__InfluenzaA__AHL81430

SEQ ID NO: 11183 - protein, 566 aa, Artificial Sequence; identical to SEQ ID NO: 630
  hemagglutinin__InfluenzaA__AHL88951

SEQ ID NO: 11184 - protein, 566 aa, Artificial Sequence; identical to SEQ ID NO: 630
  hemagglutinin__InfluenzaA__AHL89030

SEQ ID NO: 11185 - protein, 566 aa, Artificial Sequence
  hemagglutinin__InfluenzaA__AHL89042
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNENFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALVGFIMWACQKGNIRCNICI

SEQ ID NO: 11186 - protein, 566 aa, Artificial Sequence
  hemagglutinin__InfluenzaA__AHL89054
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAMSCFLLCVALLGFIMWACQKGNIRCNICI

SEQ ID NO: 11187 - protein, 566 aa, Artificial Sequence; identical to SEQ ID NO: 1581
  hemagglutinin__InfluenzaA__AHL89066

SEQ ID NO: 11188 - protein, 566 aa, Artificial Sequence
  hemagglutinin__InfluenzaA__AHL89078
MKTIIALSYILCLVFAQKLPGDDNSTATLCLGHHAVPNGTVVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11189 - protein, 566 aa, Artificial Sequence
  hemagglutinin__InfluenzaA__AHL89090
MKTIIALSYILCLVFAQKLPGNDNSTATLCLGHHAVPNGTIVKTITNDQIEVTNATELVQSSSTGGICDSPYQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11190 - protein, 566 aa, Artificial Sequence; identical to SEQ ID NO: 630
  hemagglutinin__InfluenzaA__AHL89102

SEQ ID NO: 11191 - protein, 566 aa, Artificial Sequence; identical to SEQ ID NO: 630
  hemagglutinin__InfluenzaA__AHL89114

SEQ ID NO: 11192 - protein, 566 aa, Artificial Sequence
  hemagglutinin__InfluenzaA__AHL89126
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNENFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11193 - protein, 566 aa, Artificial Sequence
  hemagglutinin__InfluenzaA__AHL89138
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQSSGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11194 - protein, 566 aa, Artificial Sequence
  hemagglutinin__InfluenzaA__AHL89150
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLVFIMWACQKGNIRCNICI

SEQ ID NO: 11195 - protein, 566 aa, Artificial Sequence
  hemagglutinin__InfluenzaA__AHL89162
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAATNQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11196 - protein, 566 aa, Artificial Sequence
  hemagglutinin__InfluenzaA__AHL89174
MKTIIALSYTLCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11197 - protein, 566 aa, Artificial Sequence
  hemagglutinin__InfluenzaA__AHL89210
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11198 - protein, 566 aa, Artificial Sequence; identical to SEQ ID NO: 11197
  hemagglutinin__InfluenzaA__AHL89222

SEQ ID NO: 11199 - protein, 566 aa, Artificial Sequence
  hemagglutinin__InfluenzaA__AHL89234
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGMGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11200 - protein, 566 aa, Artificial Sequence
  hemagglutinin__InfluenzaA__AHL89246
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCGNACIGSIRNGTYDHDVYRDEALNNRFQIKGVELKSGYKDWILWISFAISCFLLCVALLGFIMWACQKGNIRCNICI

SEQ ID NO: 11201 - protein, 566 aa, Artificial Sequence
  hemagglutinin__InfluenzaA__AHL89258
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYQALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 11202 - protein, 566 aa, Artificial Sequence; identical to SEQ ID NO: 11197
  hemagglutinin__InfluenzaA__AHL89270

SEQ ID NO: 11203 - protein, 566 aa, Artificial Sequence; identical to SEQ ID NO: 11197
  hemagglutinin__InfluenzaA__AHL89282

SEQ ID NO: 11204 - protein, 566 aa, Artificial Sequence; identical to SEQ ID NO: 11197
  hemagglutinin__InfluenzaA__AHL89294

SEQ ID NO: 11205 - protein, 566 aa, Artificial Sequence; identical to SEQ ID NO: 11197
  hemagglutinin__InfluenzaA__AHL89306

SEQ ID NO: 11206 - protein, 566 aa, Artificial Sequence; identical to SEQ ID NO: 1581
  hemagglutinin__InfluenzaA__AHL89318

SEQ ID NO: 11207 - protein, 566 aa, Artificial Sequence
  hemagglutinin__InfluenzaA__AHL89330
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11208 - protein, 566 aa, Artificial Sequence; identical to SEQ ID NO: 630
  hemagglutinin__InfluenzaA__AHL89342

SEQ ID NO: 11209 - protein, 566 aa, Artificial Sequence; identical to SEQ ID NO: 1561
  hemagglutinin__InfluenzaA__AHL89354

SEQ ID NO: 11210 - protein, 566 aa, Artificial Sequence
  hemagglutinin__InfluenzaA__AHL89366
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGIELKSGYKDWILWISFAISCFLLCVVLLGFIMWACQKGNIRCNICI

SEQ ID NO: 11211 - protein, 566 aa, Artificial Sequence; identical to SEQ ID NO: 11197
  hemagglutinin__InfluenzaA__AHL89378

SEQ ID NO: 11212 - protein, 566 aa, Artificial Sequence; identical to SEQ ID NO: 1828
  hemagglutinin__InfluenzaA__AHL89390

SEQ ID NO: 11213 - protein, 566 aa, Artificial Sequence; identical to SEQ ID NO: 11197
  hemagglutinin__InfluenzaA__AHL89402

SEQ ID NO: 11214 - protein, 566 aa, Artificial Sequence; identical to SEQ ID NO: 1581
  hemagglutinin__InfluenzaA__AHL89414

SEQ ID NO: 11215 - protein, 566 aa, Artificial Sequence
  hemagglutinin__InfluenzaA__AHL89426
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILFINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 11216 - protein, 566 aa, Artificial Sequence; identical to SEQ ID NO: 11197
  hemagglutinin__InfluenzaA__AHL89438

SEQ ID NO: 11217 - protein, 566 aa, Artificial Sequence; identical to SEQ ID NO: 11197
  hemagglutinin__InfluenzaA__AHL89450

SEQ ID NO: 11218 - protein, 566 aa, Artificial Sequence; identical to SEQ ID NO: 11197
  hemagglutinin__InfluenzaA__AHL89462

SEQ ID NO: 11219 - protein, 566 aa, Artificial Sequence; identical to SEQ ID NO: 11197
  hemagglutinin__InfluenzaA__AHL89474

SEQ ID NO: 11220 - protein, 566 aa, Artificial Sequence; identical to SEQ ID NO: 1828
  hemagglutinin__InfluenzaA__AHL89486

SEQ ID NO: 11221 - protein, 566 aa, Artificial Sequence; identical to SEQ ID NO: 1581
  hemagglutinin__InfluenzaA__AHL89498

SEQ ID NO: 11222 - protein, 566 aa, Artificial Sequence; identical to SEQ ID NO: 1581
  hemagglutinin__InfluenzaA__AHL89510

SEQ ID NO: 11223 - protein, 566 aa, Artificial Sequence; identical to SEQ ID NO: 1581
  hemagglutinin__InfluenzaA__AHL89522

SEQ ID NO: 11224 - protein, 566 aa, Artificial Sequence
  hemagglutinin__InfluenzaA__AHL89534
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGIELKSGYKDWILWISFAISCFLLCVVLLGFIMWACQKGNIRCNICI

SEQ ID NO: 11225 - protein, 565 aa, Artificial Sequence
  hemagglutinin__InfluenzaA__AHL89546
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTESAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNRERIDGVKLESMGVYQILAIYSTVASSLVLLVSLGAISFWMCSNGSLQCRICI

SEQ ID NO: 11226 - protein, 565 aa, Artificial Sequence; identical to SEQ ID NO: 1914
  hemagglutinin__InfluenzaA__AHL89558

SEQ ID NO: 11227 - protein, 565 aa, Artificial Sequence; identical to SEQ ID NO: 1914
  hemagglutinin__InfluenzaA__AHL89570

SEQ ID NO: 11228 - protein, 565 aa, Artificial Sequence; identical to SEQ ID NO: 1930
  hemagglutinin__InfluenzaA__AHL89582

SEQ ID NO: 11229 - protein, 565 aa, Artificial Sequence; identical to SEQ ID NO: 1930
  hemagglutinin__InfluenzaA__AHL89594

SEQ ID NO: 11230 - protein, 565 aa, Artificial Sequence; identical to SEQ ID NO: 1930
  hemagglutinin__InfluenzaA__AHL89606

SEQ ID NO: 11231 - protein, 565 aa, Artificial Sequence; identical to SEQ ID NO: 1914
  hemagglutinin__InfluenzaA__AHL89618

SEQ ID NO: 11232 - protein, 565 aa, Artificial Sequence; identical to SEQ ID NO: 1930
  hemagglutinin__InfluenzaA__AHL89630

SEQ ID NO: 11233 - protein, 565 aa, Artificial Sequence
  hemagglutinin__InfluenzaA__AHL89642
MKVKLLVLLCTFTATYADTICIGYHANNSTDTVDTVLEKNVTVTHSVNLLEDNHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11234 - protein, 565 aa, Artificial Sequence; identical to SEQ ID NO: 1945
  hemagglutinin__InfluenzaA__AHL89654

SEQ ID NO: 11235 - protein, 565 aa, Artificial Sequence
  hemagglutinin__InfluenzaA__AHL89666
MKVKLLVLLCTFTATYADTICIGYHANNSTDTVDTVLEKNVTVTHSVNLLEDNHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAEEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11236 - protein, 565 aa, Artificial Sequence
  hemagglutinin__InfluenzaA__AHL89678
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNRKKIDGVKLESMGVYQILAIYSTVASSLVLLVSLGAISFWMCSNGSLQCRICI

SEQ ID NO: 11237 - protein, 565 aa, Artificial Sequence
  hemagglutinin__InfluenzaA__AHL89690
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPDPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11238 - protein, 565 aa, Artificial Sequence; identical to SEQ ID NO: 1945
  hemagglutinin__InfluenzaA__AHL89702

SEQ ID NO: 11239 - protein, 565 aa, Artificial Sequence; identical to SEQ ID NO: 1914
  hemagglutinin__InfluenzaA__AHL89714

SEQ ID NO: 11240 - protein, 565 aa, Artificial Sequence
  hemagglutinin__InfluenzaA__AHL89726
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQKALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11241 - protein, 565 aa, Artificial Sequence
  hemagglutinin__InfluenzaA__AHL89750
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDGCDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11242 - protein, 565 aa, Artificial Sequence; identical to SEQ ID NO: 1910
  hemagglutinin__InfluenzaA__AHL89762

SEQ ID NO: 11243 - protein, 565 aa, Artificial Sequence; identical to SEQ ID NO: 1956
  hemagglutinin__InfluenzaA__AHL89774

SEQ ID NO: 11244 - protein, 565 aa, Artificial Sequence; identical to SEQ ID NO: 1945
  hemagglutinin__InfluenzaA__AHL89786

SEQ ID NO: 11245 - protein, 565 aa, Artificial Sequence
  hemagglutinin__InfluenzaA__AHL89798
MKVKLLVLLCTFTATYADTICIGYHANNSTDTVDTVLEKNVTVTHSVNLLEDRHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSRSYANNKEKEVLVLWGVHHPPSIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11246 - protein, 565 aa, Artificial Sequence
  hemagglutinin__InfluenzaA__AHL89810
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAECQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11247 - protein, 565 aa, Artificial Sequence
  hemagglutinin__InfluenzaA__AHL89822
MKVKLLVLLCTFTATYADTICIGYHANNSTDTVDTVLEKNVTVTHSVNLLEDRHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11248 - protein, 565 aa, Artificial Sequence
  hemagglutinin__InfluenzaA__AHL89834
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGNFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGDGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11249 - protein, 565 aa, Artificial Sequence; identical to SEQ ID NO: 1956
  hemagglutinin__InfluenzaA__AHL89846

SEQ ID NO: 11250 - protein, 566 aa, Artificial Sequence; identical to SEQ ID NO: 1928
  hemagglutinin__InfluenzaA__AHL89858

SEQ ID NO: 11251 - protein, 566 aa, Artificial Sequence; identical to SEQ ID NO: 1928
  hemagglutinin__InfluenzaA__AHL89870

SEQ ID NO: 11252 - protein, 566 aa, Artificial Sequence
  hemagglutinin__InfluenzaA__AHL89882
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSDNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11253 - protein, 566 aa, Artificial Sequence; identical to SEQ ID NO: 1928
  hemagglutinin__InfluenzaA__AHL89894

SEQ ID NO: 11254 - protein, 566 aa, Artificial Sequence
  hemagglutinin__InfluenzaA__AHL89906
MKTIIALSYILCLVYAQKLPGIDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWAGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVRQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11255 - protein, 566 aa, Artificial Sequence
  hemagglutinin__InfluenzaA__AHL89918
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQTFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11256 - protein, 566 aa, Artificial Sequence
  hemagglutinin__InfluenzaA__AHL89930
MKTIIALSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPISKCNSECITPNGSIPNDKPFQNVNRITYGACPRYVKQNTLKLATGMRNVPEKQTRGIFGAIAGFIENGWEGMVDGWYGFRHQNSEGMGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11257 - protein, 566 aa, Artificial Sequence; identical to SEQ ID NO: 1915
  hemagglutinin__InfluenzaA__AHL89942

SEQ ID NO: 11258 - protein, 566 aa, Artificial Sequence
  hemagglutinin__InfluenzaA__AHL89954
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDHASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11259 - protein, 566 aa, Artificial Sequence; identical to SEQ ID NO: 1928
  hemagglutinin__InfluenzaA__AHL89966

SEQ ID NO: 11260 - protein, 566 aa, Artificial Sequence; identical to SEQ ID NO: 1928
  hemagglutinin__InfluenzaA__AHL89978

SEQ ID NO: 11261 - protein, 566 aa, Artificial Sequence; identical to SEQ ID NO: 1987
  hemagglutinin__InfluenzaA__AHL89990

SEQ ID NO: 11262 - protein, 566 aa, Artificial Sequence
  hemagglutinin__InfluenzaA__AHL90002
MKTIIALSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGMGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11263 - protein, 566 aa, Artificial Sequence
  hemagglutinin__InfluenzaA__AHL90014
MKTIIALSYILCLVFAQKLPGNDNSTATLCLGHHAVPNGTIVKTITNDQVEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11264 - protein, 566 aa, Artificial Sequence; identical to SEQ ID NO: 11263
  hemagglutinin__InfluenzaA__AHL90026

SEQ ID NO: 11265 - protein, 566 aa, Artificial Sequence
  hemagglutinin__InfluenzaA__AHL90050
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDAEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11266 - protein, 566 aa, Artificial Sequence
  hemagglutinin__InfluenzaA__AHL90062
MKTIIALSYILCLVFAQKLPENDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNYKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11267 - protein, 566 aa, Artificial Sequence; identical to SEQ ID NO: 1928
  hemagglutinin__InfluenzaA__AHL90074

SEQ ID NO: 11268 - protein, 566 aa, Artificial Sequence
  hemagglutinin__InfluenzaA__AHL90086
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRYNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11269 - protein, 566 aa, Artificial Sequence
  hemagglutinin__InfluenzaA__AHL90098
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSDNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIDKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11270 - protein, 566 aa, Artificial Sequence
  hemagglutinin__InfluenzaA__AHL90110
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIQSGKSSVMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11271 - protein, 565 aa, Artificial Sequence; identical to SEQ ID NO: 4095
  hemagglutinin__InfluenzaA__AHL90122

SEQ ID NO: 11272 - protein, 565 aa, Artificial Sequence; identical to SEQ ID NO: 2488
  hemagglutinin__InfluenzaA__AHL90133

SEQ ID NO: 11273 - protein, 565 aa, Artificial Sequence; identical to SEQ ID NO: 4095
  hemagglutinin__InfluenzaA__AHL90145

SEQ ID NO: 11274 - protein, 565 aa, Artificial Sequence
  hemagglutinin__InfluenzaA__AHL90157
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKIQLKNNAKEIGNGCFEFYHKCNDECMESVKNGTYDYPKYSEESKLNREKIDGVKLESMGVYQILAIYSTIASSLVLLVSLGAISFWMCSNGSLQCRICI

SEQ ID NO: 11275 - protein, 565 aa, Artificial Sequence; identical to SEQ ID NO: 4095
  hemagglutinin__InfluenzaA__AHL90169

SEQ ID NO: 11276 - protein, 565 aa, Artificial Sequence
  hemagglutinin__InfluenzaA__AHL90181
MKVKLLVLLCTFAATYADTICIGYHANNSTDTVDTVLEKNVTVTHSVNLLENSHNGKLCLLKGIAPLQLGNCSVAGWILGNPECELLISKESWSYIVEKPNPKNGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11277 - protein, 565 aa, Artificial Sequence; identical to SEQ ID NO: 3170
  hemagglutinin__InfluenzaA__AHL90217

SEQ ID NO: 11278 - protein, 565 aa, Artificial Sequence; identical to SEQ ID NO: 3170
  hemagglutinin__InfluenzaA__AHL90229

SEQ ID NO: 11279 - protein, 565 aa, Artificial Sequence
  hemagglutinin__InfluenzaA__AHL90241
MKVKLLVLLCTFTATYADTICIGYHANNSTDTVDTVLEKNVTVTHSVNLLENSHNGKLCLLKGIAPLQLGNCSVAGWILGNPECELLIPKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11280 - protein, 565 aa, Artificial Sequence
  hemagglutinin__InfluenzaA__AHL90253
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKGSSWPNHTVTGVSASCSHNGESSFYRNLLWLTGKNGLYPNLSKSYANNKEKEVLVLWGVHHPPNIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEVSKLNREKIDGVKLESMGVYQILAIYSTVASSLVLLVSLGAISFWMCSNGSLQCRICI

SEQ ID NO: 11281 - protein, 565 aa, Artificial Sequence; identical to SEQ ID NO: 2488
  hemagglutinin__InfluenzaA__AHL90265

SEQ ID NO: 11282 - protein, 565 aa, Artificial Sequence
  hemagglutinin__InfluenzaA__AHL90277
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11283 - protein, 565 aa, Artificial Sequence
  hemagglutinin__InfluenzaA__AHL90289
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPRDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11284 - protein, 565 aa, Artificial Sequence; identical to SEQ ID NO: 11283
  hemagglutinin__InfluenzaA__AHL90301

SEQ ID NO: 11285 - protein, 565 aa, Artificial Sequence
  hemagglutinin__InfluenzaA__AHL90325
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEMGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11286 - protein, 565 aa, Artificial Sequence; identical to SEQ ID NO: 11285
  hemagglutinin__InfluenzaA__AHL90337

SEQ ID NO: 11287 - protein, 565 aa, Artificial Sequence; identical to SEQ ID NO: 2488
  hemagglutinin__InfluenzaA__AHL90349

SEQ ID NO: 11288 - protein, 565 aa, Artificial Sequence; identical to SEQ ID NO: 2488
  hemagglutinin__InfluenzaA__AHL90361

SEQ ID NO: 11289 - protein, 565 aa, Artificial Sequence; identical to SEQ ID NO: 11282
  hemagglutinin__InfluenzaA__AHL90373

SEQ ID NO: 11290 - protein, 566 aa, Artificial Sequence
  hemagglutinin__InfluenzaA__AHL90385
MKTIIALSYIQCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGRTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 11291 - protein, 566 aa, Artificial Sequence
  hemagglutinin__InfluenzaA__AHL90397
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCSSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11292 - protein, 566 aa, Artificial Sequence; identical to SEQ ID NO: 2434
  hemagglutinin__InfluenzaA__AHL90410

SEQ ID NO: 11293 - protein, 566 aa, Artificial Sequence
  hemagglutinin__InfluenzaA__AHL90422
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMSKLFEKTKKQLRENAEDMGNGCFKIYHKCDNTCIGSIRNGTYDHNVYRDEALNNRFQIKGVELKSGYKDWILWISFAISCFLLCVALLGFIMWACQKGNIRCNICI

SEQ ID NO: 11294 - protein, 566 aa, Artificial Sequence; identical to SEQ ID NO: 2434
  hemagglutinin__InfluenzaA__AHL90434

SEQ ID NO: 11295 - protein, 566 aa, Artificial Sequence; identical to SEQ ID NO: 2434
  hemagglutinin__InfluenzaA__AHL90446

SEQ ID NO: 11296 - protein, 566 aa, Artificial Sequence
  hemagglutinin__InfluenzaA__AHL90458
MKTIIALSYILCLVFAQKLPGNDNSTATLCLGHHAVPNGTIVKTITNDQIEVTNATELVQSSSTGEICDSPHQILDGENCALIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11297 - protein, 566 aa, Artificial Sequence; identical to SEQ ID NO: 2434
  hemagglutinin__InfluenzaA__AHL90470

SEQ ID NO: 11298 - protein, 566 aa, Artificial Sequence; identical to SEQ ID NO: 2434
  hemagglutinin__InfluenzaA__AHL90482

SEQ ID NO: 11299 - protein, 566 aa, Artificial Sequence; identical to SEQ ID NO: 2537
  hemagglutinin__InfluenzaA__AHL90494

SEQ ID NO: 11300 - protein, 566 aa, Artificial Sequence; identical to SEQ ID NO: 2537
  hemagglutinin__InfluenzaA__AHL90506

SEQ ID NO: 11301 - protein, 566 aa, Artificial Sequence
  hemagglutinin__InfluenzaA__AHL90518
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFKNESFNWTGVTQNGTSSACIRRSNNSFFSRLNWLTHLKFKYPALNVTMPNKEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11302 - protein, 566 aa, Artificial Sequence; identical to SEQ ID NO: 3213
  hemagglutinin__InfluenzaA__AHL90530

SEQ ID NO: 11303 - protein, 566 aa, Artificial Sequence; identical to SEQ ID NO: 2434
  hemagglutinin__InfluenzaA__AHL90542

SEQ ID NO: 11304 - protein, 566 aa, Artificial Sequence; identical to SEQ ID NO: 2434
  hemagglutinin__InfluenzaA__AHL90554

SEQ ID NO: 11305 - protein, 566 aa, Artificial Sequence; identical to SEQ ID NO: 2434
  hemagglutinin__InfluenzaA__AHL90566

SEQ ID NO: 11306 - protein, 566 aa, Artificial Sequence; identical to SEQ ID NO: 2434
  hemagglutinin__InfluenzaA__AHL90578

SEQ ID NO: 11307 - protein, 566 aa, Artificial Sequence; identical to SEQ ID NO: 2537
  hemagglutinin__InfluenzaA__AHL90590

SEQ ID NO: 11308 - protein, 566 aa, Artificial Sequence; identical to SEQ ID NO: 2434
  hemagglutinin__InfluenzaA__AHL90602

SEQ ID NO: 11309 - protein, 566 aa, Artificial Sequence; identical to SEQ ID NO: 2434
  hemagglutinin__InfluenzaA__AHL90614

SEQ ID NO: 11310 - protein, 566 aa, Artificial Sequence
  hemagglutinin__InfluenzaA__AHL90638
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSRKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11311 - protein, 566 aa, Artificial Sequence
  hemagglutinin__InfluenzaA__AHL90650
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQTFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11312 - protein, 566 aa, Artificial Sequence; identical to SEQ ID NO: 2434
  hemagglutinin__InfluenzaA__AHL90662

SEQ ID NO: 11313 - protein, 566 aa, Artificial Sequence
  hemagglutinin__InfluenzaA__AHL90674
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNVCIGSIRNGTYDHDVYRDEALNNRFQIKGVELKSGYKDWILWISFAISCFLLCVALLGFIMWACQKGNIRCNICI

SEQ ID NO: 11314 - protein, 566 aa, Artificial Sequence
  hemagglutinin__InfluenzaA__AHL90686
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVAMENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11315 - protein, 566 aa, Artificial Sequence; identical to SEQ ID NO: 2434
  hemagglutinin__InfluenzaA__AHL90698

SEQ ID NO: 11316 - protein, 566 aa, Artificial Sequence; identical to SEQ ID NO: 2434
  hemagglutinin__InfluenzaA__AHL90710

SEQ ID NO: 11317 - protein, 565 aa, Artificial Sequence; identical to SEQ ID NO: 5972
  hemagglutinin__InfluenzaA__AHL90722

SEQ ID NO: 11318 - protein, 565 aa, Artificial Sequence
  hemagglutinin__InfluenzaA__AHL90746
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFKRFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11319 - protein, 565 aa, Artificial Sequence; identical to SEQ ID NO: 3131
  hemagglutinin__InfluenzaA__AHL90758

SEQ ID NO: 11320 - protein, 565 aa, Artificial Sequence
  hemagglutinin__InfluenzaA__AHL90770
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKDSSWPNHTVTGVSASCSHNGESSFYRNLLWLTGKNGLYPNLSKSYANNKEKEVLVLWGVHHPPSINDQKTLYHTENAYVSVVSSHHSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILTIYSTVASSLVLLVSLGAISFWMCSNGSLQCRICI

SEQ ID NO: 11321 - protein, 565 aa, Artificial Sequence; identical to SEQ ID NO: 3616
  hemagglutinin__InfluenzaA__AHL90782

SEQ ID NO: 11322 - protein, 565 aa, Artificial Sequence
  hemagglutinin__InfluenzaA__AHL90794
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQNTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11323 - protein, 565 aa, Artificial Sequence
  hemagglutinin__InfluenzaA__AHL90806
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLISLGAISFWMCSNGSLQCRICI

SEQ ID NO: 11324 - protein, 565 aa, Artificial Sequence; identical to SEQ ID NO: 5972
  hemagglutinin__InfluenzaA__AHL90818

SEQ ID NO: 11325 - protein, 565 aa, Artificial Sequence; identical to SEQ ID NO: 5972
  hemagglutinin__InfluenzaA__AHL90830

SEQ ID NO: 11326 - protein, 565 aa, Artificial Sequence; identical to SEQ ID NO: 3131
  hemagglutinin__InfluenzaA__AHL90842

SEQ ID NO: 11327 - protein, 565 aa, Artificial Sequence; identical to SEQ ID NO: 5513
  hemagglutinin__InfluenzaA__AHL90854

SEQ ID NO: 11328 - protein, 565 aa, Artificial Sequence; identical to SEQ ID NO: 3131
  hemagglutinin__InfluenzaA__AHL90866

SEQ ID NO: 11329 - protein, 565 aa, Artificial Sequence; identical to SEQ ID NO: 5513
  hemagglutinin__InfluenzaA__AHL90878

SEQ ID NO: 11330 - protein, 565 aa, Artificial Sequence; identical to SEQ ID NO: 5972
  hemagglutinin__InfluenzaA__AHL90890

SEQ ID NO: 11331 - protein, 565 aa, Artificial Sequence; identical to SEQ ID NO: 5513
  hemagglutinin__InfluenzaA__AHL90902

SEQ ID NO: 11332 - protein, 565 aa, Artificial Sequence; identical to SEQ ID NO: 3131
  hemagglutinin__InfluenzaA__AHL90914

SEQ ID NO: 11333 - protein, 565 aa, Artificial Sequence; identical to SEQ ID NO: 5513
  hemagglutinin__InfluenzaA__AHL90938

SEQ ID NO: 11334 - protein, 565 aa, Artificial Sequence; identical to SEQ ID NO: 5513
  hemagglutinin__InfluenzaA__AHL90950

SEQ ID NO: 11335 - protein, 565 aa, Artificial Sequence; identical to SEQ ID NO: 5513
  hemagglutinin__InfluenzaA__AHL90962

SEQ ID NO: 11336 - protein, 565 aa, Artificial Sequence
  hemagglutinin__InfluenzaA__AHL90974
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISDQKTLYHTENAYVSVVSSHYSRKFTPEVAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKGQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11337 - protein, 565 aa, Artificial Sequence
  hemagglutinin__InfluenzaA__AHL90986
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSKGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 11338 - protein, 565 aa, Artificial Sequence
  hemagglutinin__InfluenzaA__AHL91010
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKDSSWPNHTVTGVSASCSHNGESSFYRNLLWLTGKNGLYPNLSKSYANNKEKEVLVLWGVHHPPSINDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILTIYSTVASSLVLLVSLGAISFWMCSNGSLQCRICI

SEQ ID NO: 11339 - protein, 565 aa, Artificial Sequence
  hemagglutinin__InfluenzaA__AHL91022
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKDSSWPNHTVTGVSASCSHNGENSFYRNLLWLTGKNGLYPNLSKSYANNKEKEVLVLWGVHHPPSINDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILTIYSTVASSLVLLVSLGAISFWMCSNGSLQCRICI

SEQ ID NO: 11340 - protein, 566 aa, Artificial Sequence; identical to SEQ ID NO: 2434
  hemagglutinin__InfluenzaA__AHL91034

SEQ ID NO: 11341 - protein, 566 aa, Artificial Sequence; identical to SEQ ID NO: 5500
  hemagglutinin__InfluenzaA__AHL91046

SEQ ID NO: 11342 - protein, 566 aa, Artificial Sequence; identical to SEQ ID NO: 11314
  hemagglutinin__InfluenzaA__AHL91058

SEQ ID NO: 11343 - protein, 566 aa, Artificial Sequence
  hemagglutinin__InfluenzaA__AHL91070
MKTIIALSYILCLVFAQKLPGNDNSMATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACMRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11344 - protein, 566 aa, Artificial Sequence
  hemagglutinin__InfluenzaA__AHL91082
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPIYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11345 - protein, 566 aa, Artificial Sequence; identical to SEQ ID NO: 5419
  hemagglutinin__InfluenzaA__AHL91094

SEQ ID NO: 11346 - protein, 566 aa, Artificial Sequence
  hemagglutinin__InfluenzaA__AHL91106
MKTIIALSYILCLVFAQKLPGNDNSTATLCLGHHAVPNGTIVKTITNDQIEVTNATELVQSSSKGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11347 - protein, 566 aa, Artificial Sequence
  hemagglutinin__InfluenzaA__AHL91118
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSKLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVTLENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11348 - protein, 566 aa, Artificial Sequence
  hemagglutinin__InfluenzaA__AHL91130
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLIASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11349 - protein, 566 aa, Artificial Sequence; identical to SEQ ID NO: 2434
  hemagglutinin__InfluenzaA__AHL91142

SEQ ID NO: 11350 - protein, 566 aa, Artificial Sequence; identical to SEQ ID NO: 2434
  hemagglutinin__InfluenzaA__AHL91154

SEQ ID NO: 11351 - protein, 566 aa, Artificial Sequence; identical to SEQ ID NO: 630
  hemagglutinin__InfluenzaA__AHL91166

SEQ ID NO: 11352 - protein, 566 aa, Artificial Sequence; identical to SEQ ID NO: 10467
  hemagglutinin__InfluenzaA__AHL94984

SEQ ID NO: 11353 - protein, 566 aa, Artificial Sequence; identical to SEQ ID NO: 10467
  hemagglutinin__InfluenzaA__AHL94996

SEQ ID NO: 11354 - protein, 566 aa, Artificial Sequence; identical to SEQ ID NO: 9835
  hemagglutinin__InfluenzaA__AHL95008

SEQ ID NO: 11355 - protein, 566 aa, Artificial Sequence; identical to SEQ ID NO: 9997
  hemagglutinin__InfluenzaA__AHL95020

SEQ ID NO: 11356 - protein, 566 aa, Artificial Sequence; identical to SEQ ID NO: 9994
  hemagglutinin__InfluenzaA__AHL95032

SEQ ID NO: 11357 - protein, 566 aa, Artificial Sequence; identical to SEQ ID NO: 9868
  hemagglutinin__InfluenzaA__AHL95044

SEQ ID NO: 11358 - protein, 566 aa, Artificial Sequence; identical to SEQ ID NO: 9858
  hemagglutinin__InfluenzaA__AHL95056

SEQ ID NO: 11359 - protein, 566 aa, Artificial Sequence; identical to SEQ ID NO: 9997
  hemagglutinin__InfluenzaA__AHL95068

SEQ ID NO: 11360 - protein, 566 aa, Artificial Sequence; identical to SEQ ID NO: 10545
  hemagglutinin__InfluenzaA__AHL95080

SEQ ID NO: 11361 - protein, 566 aa, Artificial Sequence; identical to SEQ ID NO: 9868
  hemagglutinin__InfluenzaA__AHL95092

SEQ ID NO: 11362 - protein, 566 aa, Artificial Sequence
  hemagglutinin__InfluenzaA__AHL95104
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACMRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11363 - protein, 566 aa, Artificial Sequence
  hemagglutinin__InfluenzaA__AHL95116
MKTIIALSYILCLVFAQELPGNDDSTATLCLGHYAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAKASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11364 - protein, 566 aa, Artificial Sequence; identical to SEQ ID NO: 9835
  hemagglutinin__InfluenzaA__AHL95128

SEQ ID NO: 11365 - protein, 566 aa, Artificial Sequence; identical to SEQ ID NO: 9858
  hemagglutinin__InfluenzaA__AHL95140

SEQ ID NO: 11366 - protein, 566 aa, Artificial Sequence; identical to SEQ ID NO: 9868
  hemagglutinin__InfluenzaA__AHL95152

SEQ ID NO: 11367 - protein, 566 aa, Artificial Sequence; identical to SEQ ID NO: 9835
  hemagglutinin__InfluenzaA__AHL95164

SEQ ID NO: 11368 - protein, 566 aa, Artificial Sequence; identical to SEQ ID NO: 9868
  hemagglutinin__InfluenzaA__AHL95176

SEQ ID NO: 11369 - protein, 566 aa, Artificial Sequence; identical to SEQ ID NO: 9868
  hemagglutinin__InfluenzaA__AHL95188

SEQ ID NO: 11370 - protein, 566 aa, Artificial Sequence; identical to SEQ ID NO: 9994
  hemagglutinin__InfluenzaA__AHL95200

SEQ ID NO: 11371 - protein, 566 aa, Artificial Sequence; identical to SEQ ID NO: 9868
  hemagglutinin__InfluenzaA__AHL95212

SEQ ID NO: 11372 - protein, 566 aa, Artificial Sequence; identical to SEQ ID NO: 9858
  hemagglutinin__InfluenzaA__AHL95224

SEQ ID NO: 11373 - protein, 566 aa, Artificial Sequence; identical to SEQ ID NO: 9858
  hemagglutinin__InfluenzaA__AHL95236

SEQ ID NO: 11374 - protein, 566 aa, Artificial Sequence; identical to SEQ ID NO: 9883
  hemagglutinin__InfluenzaA__AHL95248

SEQ ID NO: 11375 - protein, 566 aa, Artificial Sequence
  hemagglutinin__InfluenzaA__AHL95260
MKTIIALSYILCLVFAQKLPGNDNSTATLCLGHHAVPNGTIVKTITNDRIEVTNATELVQNSSISEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11376 - protein, 566 aa, Artificial Sequence; identical to SEQ ID NO: 9868
  hemagglutinin__InfluenzaA__AHL95272

SEQ ID NO: 11377 - protein, 566 aa, Artificial Sequence; identical to SEQ ID NO: 9994
  hemagglutinin__InfluenzaA__AHL95284

SEQ ID NO: 11378 - protein, 566 aa, Artificial Sequence
  hemagglutinin__InfluenzaA__AHL95296
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSKYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKDNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11379 - protein, 566 aa, Artificial Sequence; identical to SEQ ID NO: 9835
  hemagglutinin__InfluenzaA__AHL95307

SEQ ID NO: 11380 - protein, 566 aa, Artificial Sequence; identical to SEQ ID NO: 9858
  hemagglutinin__InfluenzaA__AHL95319

SEQ ID NO: 11381 - protein, 566 aa, Artificial Sequence
  hemagglutinin__InfluenzaA__AHL95331
MKTIIALSYILCLVFAQKLPGDDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11382 - protein, 566 aa, Artificial Sequence
  hemagglutinin__InfluenzaA__AHL95343
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIRGVELKSGYKDWILWISFAISCFLLCVALLGFIMWACQKGNIRCNICI

SEQ ID NO: 11383 - protein, 566 aa, Artificial Sequence; identical to SEQ ID NO: 9858
  hemagglutinin__InfluenzaA__AHL95432

SEQ ID NO: 11384 - protein, 566 aa, Artificial Sequence; identical to SEQ ID NO: 9994
  hemagglutinin__InfluenzaA__AHL95444

SEQ ID NO: 11385 - protein, 566 aa, Artificial Sequence; identical to SEQ ID NO: 9858
  hemagglutinin__InfluenzaA__AHL95457

SEQ ID NO: 11386 - protein, 566 aa, Artificial Sequence
  hemagglutinin__InfluenzaA__AHL95470
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVKQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVRPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 11387 - protein, 566 aa, Artificial Sequence; identical to SEQ ID NO: 9994
  hemagglutinin__InfluenzaA__AHL95482

SEQ ID NO: 11388 - protein, 566 aa, Artificial Sequence; identical to SEQ ID NO: 9994
  hemagglutinin__InfluenzaA__AHL95494

SEQ ID NO: 11389 - protein, 566 aa, Artificial Sequence
  hemagglutinin__InfluenzaA__AHL95506
MKTIIALSYILCLVFAQKLPGNDNSTATLCLGHHAVPNGTIVRTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11390 - protein, 566 aa, Artificial Sequence
  hemagglutinin__InfluenzaA__AHL95518
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNVPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11391 - protein, 566 aa, Artificial Sequence; identical to SEQ ID NO: 9868
  hemagglutinin__InfluenzaA__AHL95530

SEQ ID NO: 11392 - protein, 566 aa, Artificial Sequence; identical to SEQ ID NO: 9868
  hemagglutinin__InfluenzaA__AHL95542

SEQ ID NO: 11393 - protein, 566 aa, Artificial Sequence
  hemagglutinin__InfluenzaA__AHL95554
MKTIIALSYILCLVFAQKLPGNDNSMATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11394 - protein, 566 aa, Artificial Sequence
  hemagglutinin__InfluenzaA__AHL95566
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYARSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11395 - protein, 566 aa, Artificial Sequence
  hemagglutinin__InfluenzaA__AHL95578
MKTIIALSYILCLVFAQKLPGNDDSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11396 - protein, 566 aa, Artificial Sequence
  hemagglutinin__InfluenzaA__AHL95590
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSSCIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11397 - protein, 566 aa, Artificial Sequence; identical to SEQ ID NO: 9868
  hemagglutinin__InfluenzaA__AHL95602

SEQ ID NO: 11398 - protein, 566 aa, Artificial Sequence; identical to SEQ ID NO: 9868
  hemagglutinin__InfluenzaA__AHL95614

SEQ ID NO: 11399 - protein, 566 aa, Artificial Sequence
  hemagglutinin__InfluenzaA__AHL95626
MKTIIALSYVLCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11400 - protein, 566 aa, Artificial Sequence; identical to SEQ ID NO: 9868
  hemagglutinin__InfluenzaA__AHL95638

SEQ ID NO: 11401 - protein, 566 aa, Artificial Sequence; identical to SEQ ID NO: 9868
  hemagglutinin__InfluenzaA__AHL95650

SEQ ID NO: 11402 - protein, 566 aa, Artificial Sequence
  hemagglutinin__InfluenzaA__AHL95662
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVTLENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11403 - protein, 566 aa, Artificial Sequence; identical to SEQ ID NO: 9994
  hemagglutinin__InfluenzaA__AHL95686

SEQ ID NO: 11404 - protein, 566 aa, Artificial Sequence; identical to SEQ ID NO: 9994
  hemagglutinin__InfluenzaA__AHL95698

SEQ ID NO: 11405 - protein, 566 aa, Artificial Sequence; identical to SEQ ID NO: 9868
  hemagglutinin__InfluenzaA__AHL95710

SEQ ID NO: 11406 - protein, 566 aa, Artificial Sequence; identical to SEQ ID NO: 11382
  hemagglutinin__InfluenzaA__AHL95722

SEQ ID NO: 11407 - protein, 566 aa, Artificial Sequence; identical to SEQ ID NO: 9858
  hemagglutinin__InfluenzaA__AHL95734

SEQ ID NO: 11408 - protein, 566 aa, Artificial Sequence; identical to SEQ ID NO: 9858
  hemagglutinin__InfluenzaA__AHL95746

SEQ ID NO: 11409 - protein, 566 aa, Artificial Sequence; identical to SEQ ID NO: 9997
  hemagglutinin__InfluenzaA__AHL95758

SEQ ID NO: 11410 - protein, 566 aa, Artificial Sequence; identical to SEQ ID NO: 9868
  hemagglutinin__InfluenzaA__AHL95770

SEQ ID NO: 11411 - protein, 566 aa, Artificial Sequence
  hemagglutinin__InfluenzaA__AHL95782
MKTIIALSYILCLVFAQKLPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11412 - protein, 566 aa, Artificial Sequence
  hemagglutinin__InfluenzaA__AHL95794
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERNKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11413 - protein, 566 aa, Artificial Sequence
  hemagglutinin__InfluenzaA__AHL95806
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGSIMWACQKGNIRCNICI

SEQ ID NO: 11414 - protein, 566 aa, Artificial Sequence; identical to SEQ ID NO: 9994
  hemagglutinin__InfluenzaA__AHL95818

SEQ ID NO: 11415 - protein, 566 aa, Artificial Sequence; identical to SEQ ID NO: 9858
  hemagglutinin__InfluenzaA__AHL95830

SEQ ID NO: 11416 - protein, 566 aa, Artificial Sequence; identical to SEQ ID NO: 9994
  hemagglutinin__InfluenzaA__AHL95842

SEQ ID NO: 11417 - protein, 566 aa, Artificial Sequence; identical to SEQ ID NO: 9858
  hemagglutinin__InfluenzaA__AHL95854

SEQ ID NO: 11418 - protein, 566 aa, Artificial Sequence; identical to SEQ ID NO: 9868
  hemagglutinin__InfluenzaA__AHL95866

SEQ ID NO: 11419 - protein, 566 aa, Artificial Sequence
  hemagglutinin__InfluenzaA__AHL95878
MKAILVIMLYTFATANADTLCIGYHANNSTDTVDTVLEKNVTVTHSVNLLEDKHNGKLCKLRGVSPLHLGKCNIAGWILGNPECESLSTASSWSYIVETSGSDNGTCYPGDFIDYEELREQLSSVSSFERFEIFPKTSSWPNHDSNKGVTAACPHAGAKGFYKNLIWLVKKGNSYPKLSISYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 11420 - protein, 566 aa, Artificial Sequence; identical to SEQ ID NO: 9868
  hemagglutinin__InfluenzaA__AHL95889

SEQ ID NO: 11421 - protein, 566 aa, Artificial Sequence; identical to SEQ ID NO: 9994
  hemagglutinin__InfluenzaA__AHL95901

SEQ ID NO: 11422 - protein, 566 aa, Artificial Sequence; identical to SEQ ID NO: 9994
  hemagglutinin__InfluenzaA__AHL95913

SEQ ID NO: 11423 - protein, 566 aa, Artificial Sequence
  hemagglutinin__InfluenzaA__AHL95937
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKTDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11424 - protein, 566 aa, Artificial Sequence
  hemagglutinin__InfluenzaA__AHL95949
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSNFKYPALNMTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11425 - protein, 566 aa, Artificial Sequence; identical to SEQ ID NO: 9868
  hemagglutinin__InfluenzaA__AHL95961

SEQ ID NO: 11426 - protein, 566 aa, Artificial Sequence; identical to SEQ ID NO: 9868
  hemagglutinin__InfluenzaA__AHL95973

SEQ ID NO: 11427 - protein, 566 aa, Artificial Sequence; identical to SEQ ID NO: 9868
  hemagglutinin__InfluenzaA__AHL95985

SEQ ID NO: 11428 - protein, 566 aa, Artificial Sequence
  hemagglutinin__InfluenzaA__AHL95997
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSKSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11429 - protein, 566 aa, Artificial Sequence
  hemagglutinin__InfluenzaA__AHL96021
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSKSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11430 - protein, 566 aa, Artificial Sequence; identical to SEQ ID NO: 9868
  hemagglutinin__InfluenzaA__AHL96033

SEQ ID NO: 11431 - protein, 566 aa, Artificial Sequence; identical to SEQ ID NO: 10123
  hemagglutinin__InfluenzaA__AHL96045

SEQ ID NO: 11432 - protein, 566 aa, Artificial Sequence; identical to SEQ ID NO: 9994
  hemagglutinin__InfluenzaA__AHL96056

SEQ ID NO: 11433 - protein, 566 aa, Artificial Sequence; identical to SEQ ID NO: 9858
  hemagglutinin__InfluenzaA__AHL96068

SEQ ID NO: 11434 - protein, 566 aa, Artificial Sequence; identical to SEQ ID NO: 9868
  hemagglutinin__InfluenzaA__AHL96080

SEQ ID NO: 11435 - protein, 566 aa, Artificial Sequence
  hemagglutinin__InfluenzaA__AHL96092
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFIERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11436 - protein, 566 aa, Artificial Sequence
  hemagglutinin__InfluenzaA__AHL96104
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11437 - protein, 566 aa, Artificial Sequence; identical to SEQ ID NO: 10482
  hemagglutinin__InfluenzaA__AHL96116

SEQ ID NO: 11438 - protein, 566 aa, Artificial Sequence; identical to SEQ ID NO: 9858
  hemagglutinin__InfluenzaA__AHL96128

SEQ ID NO: 11439 - protein, 566 aa, Artificial Sequence; identical to SEQ ID NO: 9994
  hemagglutinin__InfluenzaA__AHL96152

SEQ ID NO: 11440 - protein, 566 aa, Artificial Sequence
  hemagglutinin__InfluenzaA__AHL96164
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKNWILWISFAISCFLLCVALLGFIMWACQKGNIRCNICI

SEQ ID NO: 11441 - protein, 566 aa, Artificial Sequence; identical to SEQ ID NO: 9994
  hemagglutinin__InfluenzaA__AHL96176

SEQ ID NO: 11442 - protein, 566 aa, Artificial Sequence; identical to SEQ ID NO: 9994
  hemagglutinin__InfluenzaA__AHL96188

SEQ ID NO: 11443 - protein, 566 aa, Artificial Sequence
  hemagglutinin__InfluenzaA__AHL96200
MKTIIALSYILCLVFAQKLPGNDNSTATLCLGHHAVPNGTIVKTITNDRIEVTNATELVQNSSIGEICDSPHQVLDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11444 - protein, 566 aa, Artificial Sequence; identical to SEQ ID NO: 9858
  hemagglutinin__InfluenzaA__AHL96212

SEQ ID NO: 11445 - protein, 566 aa, Artificial Sequence; identical to SEQ ID NO: 10467
  hemagglutinin__InfluenzaA__AHL96224

SEQ ID NO: 11446 - protein, 566 aa, Artificial Sequence
  hemagglutinin__InfluenzaA__AHL96236
MKTIIALSYILCLVFAQKLPGNDNSTATLCLGHHAVPNGTIVKTITNDRIEVTNATELVQNSSMGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIESIRNGTYDHDVYRDEALNNRFQIKGVELKSGYKNWILWISFAISCFLLCVALLGFIMWACQKGNIRCNICI

SEQ ID NO: 11447 - protein, 566 aa, Artificial Sequence
  hemagglutinin__InfluenzaA__AHL96248
MKTIIALGYILCLVFAQKLPGNDNSTATLCLGHHAVPNGTIVKTITNDRIEVTNATELVQNSSIGEICDSPHQILDGENCTLIDALLGDPQCDGFQNKKWDLFIERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11448 - protein, 566 aa, Artificial Sequence; identical to SEQ ID NO: 9994
  hemagglutinin__InfluenzaA__AHL96260

SEQ ID NO: 11449 - protein, 566 aa, Artificial Sequence; identical to SEQ ID NO: 9858
  hemagglutinin__InfluenzaA__AHL96274

SEQ ID NO: 11450 - protein, 566 aa, Artificial Sequence; identical to SEQ ID NO: 9994
  hemagglutinin__InfluenzaA__AHL96304

SEQ ID NO: 11451 - protein, 566 aa, Artificial Sequence; identical to SEQ ID NO: 9835
  hemagglutinin__InfluenzaA__AHL96318

SEQ ID NO: 11452 - protein, 566 aa, Artificial Sequence; identical to SEQ ID NO: 9994
  hemagglutinin__InfluenzaA__AHL96330

SEQ ID NO: 11453 - protein, 566 aa, Artificial Sequence; identical to SEQ ID NO: 9997
  hemagglutinin__InfluenzaA__AHL96342

SEQ ID NO: 11454 - protein, 566 aa, Artificial Sequence
  hemagglutinin__InfluenzaA__AHL96354
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHLNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11455 - protein, 566 aa, Artificial Sequence
  hemagglutinin__InfluenzaA__AHL96366
MKTIIALSYILCLVFAQKLPENDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11456 - protein, 566 aa, Artificial Sequence; identical to SEQ ID NO: 9868
  hemagglutinin__InfluenzaA__AHL96378

SEQ ID NO: 11457 - protein, 566 aa, Artificial Sequence; identical to SEQ ID NO: 9858
  hemagglutinin__InfluenzaA__AHL96390

SEQ ID NO: 11458 - protein, 566 aa, Artificial Sequence
  hemagglutinin__InfluenzaA__AHL96402
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNKKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11459 - protein, 566 aa, Artificial Sequence; identical to SEQ ID NO: 9868
  hemagglutinin__InfluenzaA__AHL96414

SEQ ID NO: 11460 - protein, 566 aa, Artificial Sequence; identical to SEQ ID NO: 9994
  hemagglutinin__InfluenzaA__AHL96426

SEQ ID NO: 11461 - protein, 566 aa, Artificial Sequence
  hemagglutinin__InfluenzaA__AHL96438
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCSSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11462 - protein, 566 aa, Artificial Sequence; identical to SEQ ID NO: 9868
  hemagglutinin__InfluenzaA__AHL96450

SEQ ID NO: 11463 - protein, 566 aa, Artificial Sequence; identical to SEQ ID NO: 9994
  hemagglutinin__InfluenzaA__AHL96462

SEQ ID NO: 11464 - protein, 566 aa, Artificial Sequence
  hemagglutinin__InfluenzaA__AHL96474
MKAILVVMLYTFATANADTLCIGYHANNSTDTVDTVLEKNVTVTHSVNLLEDKHNGKLCKLRGVSPLHLGKCNIAGWILGNPECESLSTASSWSYIVETSGSDNGTCYPGDFIDYEELREQLSSVSSFERFEIFPKTSSWPNHDSNKGVTAACPHAGAKGFYKNLIWLVKKGNSYPKLSISYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 11465 - protein, 566 aa, Artificial Sequence
  hemagglutinin__InfluenzaA__AHL96485
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMKSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11466 - protein, 566 aa, Artificial Sequence; identical to SEQ ID NO: 9994
  hemagglutinin__InfluenzaA__AHL96497

SEQ ID NO: 11467 - protein, 566 aa, Artificial Sequence; identical to SEQ ID NO: 9868
  hemagglutinin__InfluenzaA__AHL96509

SEQ ID NO: 11468 - protein, 566 aa, Artificial Sequence; identical to SEQ ID NO: 9835
  hemagglutinin__InfluenzaA__AHL96521

SEQ ID NO: 11469 - protein, 566 aa, Artificial Sequence; identical to SEQ ID NO: 9994
  hemagglutinin__InfluenzaA__AHL96533

SEQ ID NO: 11470 - protein, 566 aa, Artificial Sequence; identical to SEQ ID NO: 9858
  hemagglutinin__InfluenzaA__AHL96545

SEQ ID NO: 11471 - protein, 566 aa, Artificial Sequence
  hemagglutinin__InfluenzaA__AHL96569
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRVTVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11472 - protein, 566 aa, Artificial Sequence; identical to SEQ ID NO: 11464
  hemagglutinin__InfluenzaA__AHL96581

SEQ ID NO: 11473 - protein, 566 aa, Artificial Sequence
  hemagglutinin__InfluenzaA__AHL96592
MKTIIALGYILCLVFAQKIPGNDNSTATLCLGHHAVPNGTIVKTITNDRIEVTNATELVQNSSIGEICDSPHQILDGENCTLIDALLGDPQCDGFQNKKWDLFIERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11474 - protein, 566 aa, Artificial Sequence; identical to SEQ ID NO: 9994
  hemagglutinin__InfluenzaA__AHL96604

SEQ ID NO: 11475 - protein, 566 aa, Artificial Sequence; identical to SEQ ID NO: 9994
  hemagglutinin__InfluenzaA__AHL96616

SEQ ID NO: 11476 - protein, 566 aa, Artificial Sequence
  hemagglutinin__InfluenzaA__AHL96628
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWGGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11477 - protein, 566 aa, Artificial Sequence; identical to SEQ ID NO: 11465
  hemagglutinin__InfluenzaA__AHL96640

SEQ ID NO: 11478 - protein, 566 aa, Artificial Sequence
  hemagglutinin__InfluenzaA__AHL96652
MKTIIALSYILCLVFAQKLPGNDNSTATLCLGHHAVPNGTIVKTITNDRIEVTNATELVQDSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11479 - protein, 566 aa, Artificial Sequence; identical to SEQ ID NO: 10467
  hemagglutinin__InfluenzaA__AHL96664

SEQ ID NO: 11480 - protein, 566 aa, Artificial Sequence
  hemagglutinin__InfluenzaA__AHL96676
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPIDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11481 - protein, 566 aa, Artificial Sequence; identical to SEQ ID NO: 9994
  hemagglutinin__InfluenzaA__AHL96688

SEQ ID NO: 11482 - protein, 566 aa, Artificial Sequence; identical to SEQ ID NO: 9994
  hemagglutinin__InfluenzaA__AHL96700

SEQ ID NO: 11483 - protein, 566 aa, Artificial Sequence; identical to SEQ ID NO: 9994
  hemagglutinin__InfluenzaA__AHL96712

SEQ ID NO: 11484 - protein, 566 aa, Artificial Sequence; identical to SEQ ID NO: 9868
  hemagglutinin__InfluenzaA__AHL96724

SEQ ID NO: 11485 - protein, 566 aa, Artificial Sequence; identical to SEQ ID NO: 9858
  hemagglutinin__InfluenzaA__AHL96748

SEQ ID NO: 11486 - protein, 566 aa, Artificial Sequence; identical to SEQ ID NO: 9868
  hemagglutinin__InfluenzaA__AHL96784

SEQ ID NO: 11487 - protein, 566 aa, Artificial Sequence
  hemagglutinin__InfluenzaA__AHL96796
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFIERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11488 - protein, 566 aa, Artificial Sequence; identical to SEQ ID NO: 9858
  hemagglutinin__InfluenzaA__AHL96808

SEQ ID NO: 11489 - protein, 566 aa, Artificial Sequence; identical to SEQ ID NO: 9858
  hemagglutinin__InfluenzaA__AHL96820

SEQ ID NO: 11490 - protein, 566 aa, Artificial Sequence; identical to SEQ ID NO: 9868
  hemagglutinin__InfluenzaA__AHL96832

SEQ ID NO: 11491 - protein, 566 aa, Artificial Sequence; identical to SEQ ID NO: 9868
  hemagglutinin__InfluenzaA__AHL96844

SEQ ID NO: 11492 - protein, 566 aa, Artificial Sequence; identical to SEQ ID NO: 9868
  hemagglutinin__InfluenzaA__AHL96856

SEQ ID NO: 11493 - protein, 566 aa, Artificial Sequence
  hemagglutinin__InfluenzaA__AHL96868
MKTIIALSYILCLVFAQKLPGNDNSTATLCLGHHAVPNGTIVKTITNDRIEVTNATELVQNSSIGEICDSPHQILDGGNCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVVPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAMSCFLLCVALLGFIMWACQKGNIRCNICI

SEQ ID NO: 11494 - protein, 566 aa, Artificial Sequence; identical to SEQ ID NO: 9858
  hemagglutinin__InfluenzaA__AHL96880

SEQ ID NO: 11495 - protein, 566 aa, Artificial Sequence
  hemagglutinin__InfluenzaA__AHL96892
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRVQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11496 - protein, 566 aa, Artificial Sequence
  hemagglutinin__InfluenzaA__AHL96904
MKTIIALSYILCLVFAQKLPGNDNSTATLCLGHHAVPNGMIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVVPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAMSCFLLCVALLGSIMWACQKGNIRCNICI

SEQ ID NO: 11497 - protein, 566 aa, Artificial Sequence; identical to SEQ ID NO: 9858
  hemagglutinin__InfluenzaA__AHL96916

SEQ ID NO: 11498 - protein, 566 aa, Artificial Sequence; identical to SEQ ID NO: 9858
  hemagglutinin__InfluenzaA__AHL96928

SEQ ID NO: 11499 - protein, 566 aa, Artificial Sequence; identical to SEQ ID NO: 9858
  hemagglutinin__InfluenzaA__AHL96940

SEQ ID NO: 11500 - protein, 566 aa, Artificial Sequence; identical to SEQ ID NO: 9868
  hemagglutinin__InfluenzaA__AHL96952

SEQ ID NO: 11501 - protein, 566 aa, Artificial Sequence; identical to SEQ ID NO: 9868
  hemagglutinin__InfluenzaA__AHL96964

SEQ ID NO: 11502 - protein, 566 aa, Artificial Sequence; identical to SEQ ID NO: 10026
  hemagglutinin__InfluenzaA__AHL96976

SEQ ID NO: 11503 - protein, 566 aa, Artificial Sequence
  hemagglutinin__InfluenzaA__AHL96988
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVRPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11504 - protein, 566 aa, Artificial Sequence; identical to SEQ ID NO: 9868
  hemagglutinin__InfluenzaA__AHL97000

SEQ ID NO: 11505 - protein, 566 aa, Artificial Sequence; identical to SEQ ID NO: 9994
  hemagglutinin__InfluenzaA__AHL97012

SEQ ID NO: 11506 - protein, 566 aa, Artificial Sequence
  hemagglutinin__InfluenzaA__AHL97024
MKTIIALSYILCLVFAQKLPGNDNSTATLCLGHHAVPNGTIVKTIMNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11507 - protein, 566 aa, Artificial Sequence
  hemagglutinin__InfluenzaA__AHL97036
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNTCIGSIRNGTYDHDVYRDEALNNRFQIKGVELKSGYKDWILWISFAISCFLLCVALLGFIMWACQKGNIRCNICI

SEQ ID NO: 11508 - protein, 566 aa, Artificial Sequence; identical to SEQ ID NO: 9883
  hemagglutinin__InfluenzaA__AHL97048

SEQ ID NO: 11509 - protein, 566 aa, Artificial Sequence
  hemagglutinin__InfluenzaA__AHL97060
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYEHDVYRDEALNNRFQIKGVELKSGYKDWILWISFAISCFLLCVALLGFIMWACQKGNIRCNICI

SEQ ID NO: 11510 - protein, 566 aa, Artificial Sequence; identical to SEQ ID NO: 9994
  hemagglutinin__InfluenzaA__AHL97072

SEQ ID NO: 11511 - protein, 566 aa, Artificial Sequence; identical to SEQ ID NO: 9994
  hemagglutinin__InfluenzaA__AHL97084

SEQ ID NO: 11512 - protein, 566 aa, Artificial Sequence; identical to SEQ ID NO: 9835
  hemagglutinin__InfluenzaA__AHL97096

SEQ ID NO: 11513 - protein, 566 aa, Artificial Sequence; identical to SEQ ID NO: 9997
  hemagglutinin__InfluenzaA__AHL97108

SEQ ID NO: 11514 - protein, 566 aa, Artificial Sequence
  hemagglutinin__InfluenzaA__AHL97120
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRVTYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIINGTYDHDVYRDEALNNRFQIKGVELKSGYKDWILWISFAISCFLLCVALLGFIMWACQKGNIRCNICI

SEQ ID NO: 11515 - protein, 566 aa, Artificial Sequence
  hemagglutinin__InfluenzaA__AHL97132
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPGKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11516 - protein, 566 aa, Artificial Sequence; identical to SEQ ID NO: 9994
  hemagglutinin__InfluenzaA__AHL97144

SEQ ID NO: 11517 - protein, 566 aa, Artificial Sequence; identical to SEQ ID NO: 9994
  hemagglutinin__InfluenzaA__AHL97156

SEQ ID NO: 11518 - protein, 566 aa, Artificial Sequence; identical to SEQ ID NO: 9994
  hemagglutinin__InfluenzaA__AHL97168

SEQ ID NO: 11519 - protein, 566 aa, Artificial Sequence; identical to SEQ ID NO: 9868
  hemagglutinin__InfluenzaA__AHL97180

SEQ ID NO: 11520 - protein, 566 aa, Artificial Sequence; identical to SEQ ID NO: 9994
  hemagglutinin__InfluenzaA__AHL97192

SEQ ID NO: 11521 - protein, 566 aa, Artificial Sequence; identical to SEQ ID NO: 9994
  hemagglutinin__InfluenzaA__AHL97204

SEQ ID NO: 11522 - protein, 566 aa, Artificial Sequence; identical to SEQ ID NO: 9994
  hemagglutinin__InfluenzaA__AHL97216

SEQ ID NO: 11523 - protein, 566 aa, Artificial Sequence
  hemagglutinin__InfluenzaA__AHL97228
MKTIIALSYILCLVFAQKLPGNDNSTATLCLGHHAVPNGTVVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 11524 - protein, 566 aa, Artificial Sequence; identical to SEQ ID NO: 9994
  hemagglutinin__InfluenzaA__AHL97240

SEQ ID NO: 11525 - protein, 566 aa, Artificial Sequence
  hemagglutinin__InfluenzaA__AHL97252
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNENFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11526 - protein, 566 aa, Artificial Sequence; identical to SEQ ID NO: 9858
  hemagglutinin__InfluenzaA__AHL97264

SEQ ID NO: 11527 - protein, 566 aa, Artificial Sequence; identical to SEQ ID NO: 9994
  hemagglutinin__InfluenzaA__AHL97276

SEQ ID NO: 11528 - protein, 566 aa, Artificial Sequence
  hemagglutinin__InfluenzaA__AHL97288
MKTIIALSYILCLVFAQKLPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKIKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11529 - protein, 566 aa, Artificial Sequence; identical to SEQ ID NO: 9868
  hemagglutinin__InfluenzaA__AHL97300

SEQ ID NO: 11530 - protein, 566 aa, Artificial Sequence; identical to SEQ ID NO: 9994
  hemagglutinin__InfluenzaA__AHL97312

SEQ ID NO: 11531 - protein, 566 aa, Artificial Sequence; identical to SEQ ID NO: 9994
  hemagglutinin__InfluenzaA__AHL97336

SEQ ID NO: 11532 - protein, 566 aa, Artificial Sequence; identical to SEQ ID NO: 9994
  hemagglutinin__InfluenzaA__AHL97348

SEQ ID NO: 11533 - protein, 566 aa, Artificial Sequence
  hemagglutinin__InfluenzaA__AHL97372
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSNAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11534 - protein, 566 aa, Artificial Sequence; identical to SEQ ID NO: 9994
  hemagglutinin__InfluenzaA__AHL97384

SEQ ID NO: 11535 - protein, 566 aa, Artificial Sequence; identical to SEQ ID NO: 9858
  hemagglutinin__InfluenzaA__AHL97396

SEQ ID NO: 11536 - protein, 566 aa, Artificial Sequence; identical to SEQ ID NO: 9835
  hemagglutinin__InfluenzaA__AHL97408

SEQ ID NO: 11537 - protein, 566 aa, Artificial Sequence; identical to SEQ ID NO: 11506
  hemagglutinin__InfluenzaA__AHL97420

SEQ ID NO: 11538 - protein, 566 aa, Artificial Sequence
  hemagglutinin__InfluenzaA__AHL97444
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGTCPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11539 - protein, 566 aa, Artificial Sequence; identical to SEQ ID NO: 9868
  hemagglutinin__InfluenzaA__AHL97456

SEQ ID NO: 11540 - protein, 566 aa, Artificial Sequence
  hemagglutinin__InfluenzaA__AHL97468
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11541 - protein, 566 aa, Artificial Sequence; identical to SEQ ID NO: 9994
  hemagglutinin__InfluenzaA__AHL97480

SEQ ID NO: 11542 - protein, 566 aa, Artificial Sequence; identical to SEQ ID NO: 9994
  hemagglutinin__InfluenzaA__AHL97493

SEQ ID NO: 11543 - protein, 566 aa, Artificial Sequence; identical to SEQ ID NO: 11506
  hemagglutinin__InfluenzaA__AHL97505

SEQ ID NO: 11544 - protein, 566 aa, Artificial Sequence
  hemagglutinin__InfluenzaA__AHL97517
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTQRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11545 - protein, 566 aa, Artificial Sequence; identical to SEQ ID NO: 9883
  hemagglutinin__InfluenzaA__AHL97529

SEQ ID NO: 11546 - protein, 566 aa, Artificial Sequence; identical to SEQ ID NO: 9868
  hemagglutinin__InfluenzaA__AHL97541

SEQ ID NO: 11547 - protein, 566 aa, Artificial Sequence; identical to SEQ ID NO: 9994
  hemagglutinin__InfluenzaA__AHL97553

SEQ ID NO: 11548 - protein, 566 aa, Artificial Sequence; identical to SEQ ID NO: 9835
  hemagglutinin__InfluenzaA__AHL97565

SEQ ID NO: 11549 - protein, 566 aa, Artificial Sequence
  hemagglutinin__InfluenzaA__AHL97577
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKPGYKDWILWISFAISCFLLCVALLGFIMWACQKGNIRCNICI

SEQ ID NO: 11550 - protein, 566 aa, Artificial Sequence; identical to SEQ ID NO: 10023
  hemagglutinin__InfluenzaA__AHL97589

SEQ ID NO: 11551 - protein, 566 aa, Artificial Sequence; identical to SEQ ID NO: 9994
  hemagglutinin__InfluenzaA__AHL97601

SEQ ID NO: 11552 - protein, 566 aa, Artificial Sequence; identical to SEQ ID NO: 9858
  hemagglutinin__InfluenzaA__AHL97613

SEQ ID NO: 11553 - protein, 566 aa, Artificial Sequence; identical to SEQ ID NO: 11540
  hemagglutinin__InfluenzaA__AHL97625

SEQ ID NO: 11554 - protein, 566 aa, Artificial Sequence; identical to SEQ ID NO: 9868
  hemagglutinin__InfluenzaA__AHL97637

SEQ ID NO: 11555 - protein, 566 aa, Artificial Sequence
  hemagglutinin__InfluenzaA__AHL97661
MKTIIALGYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11556 - protein, 566 aa, Artificial Sequence
  hemagglutinin__InfluenzaA__AHL97673
MKTTIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11557 - protein, 566 aa, Artificial Sequence; identical to SEQ ID NO: 9994
  hemagglutinin__InfluenzaA__AHL97685

SEQ ID NO: 11558 - protein, 566 aa, Artificial Sequence
  hemagglutinin__InfluenzaA__AHL97697
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERGKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11559 - protein, 566 aa, Artificial Sequence; identical to SEQ ID NO: 9868
  hemagglutinin__InfluenzaA__AHL97709

SEQ ID NO: 11560 - protein, 566 aa, Artificial Sequence; identical to SEQ ID NO: 9994
  hemagglutinin__InfluenzaA__AHL97721

SEQ ID NO: 11561 - protein, 566 aa, Artificial Sequence; identical to SEQ ID NO: 9868
  hemagglutinin__InfluenzaA__AHL97733

SEQ ID NO: 11562 - protein, 566 aa, Artificial Sequence; identical to SEQ ID NO: 9858
  hemagglutinin__InfluenzaA__AHL97745

SEQ ID NO: 11563 - protein, 566 aa, Artificial Sequence; identical to SEQ ID NO: 9994
  hemagglutinin__InfluenzaA__AHL97757

SEQ ID NO: 11564 - protein, 566 aa, Artificial Sequence; identical to SEQ ID NO: 9994
  hemagglutinin__InfluenzaA__AHL97769

SEQ ID NO: 11565 - protein, 566 aa, Artificial Sequence
  hemagglutinin__InfluenzaA__AHL97781
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGNSSIMRSDAPIGKCNSTCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11566 - protein, 566 aa, Artificial Sequence; identical to SEQ ID NO: 9994
  hemagglutinin__InfluenzaA__AHL97793

SEQ ID NO: 11567 - protein, 566 aa, Artificial Sequence
  hemagglutinin__InfluenzaA__AHL97805
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNYEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11568 - protein, 566 aa, Artificial Sequence; identical to SEQ ID NO: 9868
  hemagglutinin__InfluenzaA__AHL97817

SEQ ID NO: 11569 - protein, 566 aa, Artificial Sequence; identical to SEQ ID NO: 11558
  hemagglutinin__InfluenzaA__AHL97829

SEQ ID NO: 11570 - protein, 566 aa, Artificial Sequence; identical to SEQ ID NO: 9994
  hemagglutinin__InfluenzaA__AHL97841

SEQ ID NO: 11571 - protein, 566 aa, Artificial Sequence; identical to SEQ ID NO: 9994
  hemagglutinin__InfluenzaA__AHL97853

SEQ ID NO: 11572 - protein, 566 aa, Artificial Sequence; identical to SEQ ID NO: 9994
  hemagglutinin__InfluenzaA__AHL97865

SEQ ID NO: 11573 - protein, 566 aa, Artificial Sequence; identical to SEQ ID NO: 9994
  hemagglutinin__InfluenzaA__AHL97877

SEQ ID NO: 11574 - protein, 566 aa, Artificial Sequence; identical to SEQ ID NO: 9868
  hemagglutinin__InfluenzaA__AHL97889

SEQ ID NO: 11575 - protein, 566 aa, Artificial Sequence; identical to SEQ ID NO: 9868
  hemagglutinin__InfluenzaA__AHL97901

SEQ ID NO: 11576 - protein, 566 aa, Artificial Sequence; identical to SEQ ID NO: 9858
  hemagglutinin__InfluenzaA__AHL97913

SEQ ID NO: 11577 - protein, 566 aa, Artificial Sequence
  hemagglutinin__InfluenzaA__AHL97925
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKLLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11578 - protein, 566 aa, Artificial Sequence; identical to SEQ ID NO: 9858
  hemagglutinin__InfluenzaA__AHL97937

SEQ ID NO: 11579 - protein, 566 aa, Artificial Sequence; identical to SEQ ID NO: 11538
  hemagglutinin__InfluenzaA__AHL97949

SEQ ID NO: 11580 - protein, 566 aa, Artificial Sequence; identical to SEQ ID NO: 9868
  hemagglutinin__InfluenzaA__AHL97961

SEQ ID NO: 11581 - protein, 566 aa, Artificial Sequence; identical to SEQ ID NO: 9868
  hemagglutinin__InfluenzaA__AHL97973

SEQ ID NO: 11582 - protein, 566 aa, Artificial Sequence; identical to SEQ ID NO: 9868
  hemagglutinin__InfluenzaA__AHL97985

SEQ ID NO: 11583 - protein, 566 aa, Artificial Sequence
  hemagglutinin__InfluenzaA__AHL97997
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIRGVELKSGYKDWILWISFAISCFLLCVALLGFIMWACQKGNIRCNICI

SEQ ID NO: 11584 - protein, 566 aa, Artificial Sequence; identical to SEQ ID NO: 9994
  hemagglutinin__InfluenzaA__AHL98009

SEQ ID NO: 11585 - protein, 566 aa, Artificial Sequence
  hemagglutinin__InfluenzaA__AHL98021
MKTIIALSYILCLVFAQKLPGNDNSTATLCLGHHAVPNGTIVKTITNDRIEVTNATELVQNSSIGKICDSPHQILDGENCTLMDALLGDPQCDGFQNKKWDLFVERSKAYSNCYPYDVPDYASLRSLVASSGTLEFNNESFNWAGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11586 - protein, 566 aa, Artificial Sequence; identical to SEQ ID NO: 9868
  hemagglutinin__InfluenzaA__AHL98033

SEQ ID NO: 11587 - protein, 566 aa, Artificial Sequence; identical to SEQ ID NO: 11465
  hemagglutinin__InfluenzaA__AHL98045

SEQ ID NO: 11588 - protein, 566 aa, Artificial Sequence; identical to SEQ ID NO: 11465
  hemagglutinin__InfluenzaA__AHL98057

SEQ ID NO: 11589 - protein, 566 aa, Artificial Sequence; identical to SEQ ID NO: 11465
  hemagglutinin__InfluenzaA__AHL98069

SEQ ID NO: 11590 - protein, 566 aa, Artificial Sequence
  hemagglutinin__InfluenzaA__AHL98081
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSNSSFFSRLNWLTHLNFKYPALNVTMPNNEQFDKLYIWGVHHPGTDKDQIFLYAQSSGRITVSTQRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLVGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11591 - protein, 566 aa, Artificial Sequence; identical to SEQ ID NO: 9858
  hemagglutinin__InfluenzaA__AHL98093

SEQ ID NO: 11592 - protein, 566 aa, Artificial Sequence
  hemagglutinin__InfluenzaA__AHL98105
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPHAGAKGFYKNLIWLVKKGNSYPKLSISYINDKGKEVLVLWGIHHPSTTADQQSLYQNADTYVFVGASRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 11593 - protein, 566 aa, Artificial Sequence; identical to SEQ ID NO: 9858
  hemagglutinin__InfluenzaA__AHL98116

SEQ ID NO: 11594 - protein, 566 aa, Artificial Sequence; identical to SEQ ID NO: 9868
  hemagglutinin__InfluenzaA__AHL98128

SEQ ID NO: 11595 - protein, 566 aa, Artificial Sequence; identical to SEQ ID NO: 9858
  hemagglutinin__InfluenzaA__AHL98140

SEQ ID NO: 11596 - protein, 566 aa, Artificial Sequence; identical to SEQ ID NO: 9858
  hemagglutinin__InfluenzaA__AHL98152

SEQ ID NO: 11597 - protein, 566 aa, Artificial Sequence; identical to SEQ ID NO: 9868
  hemagglutinin__InfluenzaA__AHL98164

SEQ ID NO: 11598 - protein, 566 aa, Artificial Sequence; identical to SEQ ID NO: 9868
  hemagglutinin__InfluenzaA__AHL98176

SEQ ID NO: 11599 - protein, 566 aa, Artificial Sequence; identical to SEQ ID NO: 9858
  hemagglutinin__InfluenzaA__AHL98188

SEQ ID NO: 11600 - protein, 566 aa, Artificial Sequence; identical to SEQ ID NO: 10023
  hemagglutinin__InfluenzaA__AHL98200

SEQ ID NO: 11601 - protein, 566 aa, Artificial Sequence; identical to SEQ ID NO: 9858
  hemagglutinin__InfluenzaA__AHL98212

SEQ ID NO: 11602 - protein, 566 aa, Artificial Sequence; identical to SEQ ID NO: 9858
  hemagglutinin__InfluenzaA__AHL98224

SEQ ID NO: 11603 - protein, 566 aa, Artificial Sequence; identical to SEQ ID NO: 9994
  hemagglutinin__InfluenzaA__AHL98236

SEQ ID NO: 11604 - protein, 566 aa, Artificial Sequence; identical to SEQ ID NO: 9868
  hemagglutinin__InfluenzaA__AHL98248

SEQ ID NO: 11605 - protein, 566 aa, Artificial Sequence; identical to SEQ ID NO: 9858
  hemagglutinin__InfluenzaA__AHL98260

SEQ ID NO: 11606 - protein, 566 aa, Artificial Sequence; identical to SEQ ID NO: 9868
  hemagglutinin__InfluenzaA__AHL98272

SEQ ID NO: 11607 - protein, 566 aa, Artificial Sequence; identical to SEQ ID NO: 11464
  hemagglutinin__InfluenzaA__AHL98284

SEQ ID NO: 11608 - protein, 566 aa, Artificial Sequence
  hemagglutinin__InfluenzaA__AHL98295
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11609 - protein, 566 aa, Artificial Sequence; identical to SEQ ID NO: 11506
  hemagglutinin__InfluenzaA__AHL98307

SEQ ID NO: 11610 - protein, 566 aa, Artificial Sequence; identical to SEQ ID NO: 9868
  hemagglutinin__InfluenzaA__AHL98319

SEQ ID NO: 11611 - protein, 566 aa, Artificial Sequence; identical to SEQ ID NO: 9868
  hemagglutinin__InfluenzaA__AHL98331

SEQ ID NO: 11612 - protein, 566 aa, Artificial Sequence; identical to SEQ ID NO: 9994
  hemagglutinin__InfluenzaA__AHL98343

SEQ ID NO: 11613 - protein, 566 aa, Artificial Sequence; identical to SEQ ID NO: 11506
  hemagglutinin__InfluenzaA__AHL98354

SEQ ID NO: 11614 - protein, 566 aa, Artificial Sequence; identical to SEQ ID NO: 9858
  hemagglutinin__InfluenzaA__AHL98366

SEQ ID NO: 11615 - protein, 566 aa, Artificial Sequence; identical to SEQ ID NO: 9858
  hemagglutinin__InfluenzaA__AHL98378

SEQ ID NO: 11616 - protein, 566 aa, Artificial Sequence; identical to SEQ ID NO: 9858
  hemagglutinin__InfluenzaA__AHL98390

SEQ ID NO: 11617 - protein, 566 aa, Artificial Sequence; identical to SEQ ID NO: 9858
  hemagglutinin__InfluenzaA__AHL98402

SEQ ID NO: 11618 - protein, 566 aa, Artificial Sequence; identical to SEQ ID NO: 9868
  hemagglutinin__InfluenzaA__AHL98414

SEQ ID NO: 11619 - protein, 566 aa, Artificial Sequence
  hemagglutinin__InfluenzaA__AHL98426
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQVKGVELKSGYKDWILWISFAISCFLLCVALLGFIMWACQKGNIRCNICI

SEQ ID NO: 11620 - protein, 566 aa, Artificial Sequence; identical to SEQ ID NO: 10040
  hemagglutinin__InfluenzaA__AHL98438

SEQ ID NO: 11621 - protein, 566 aa, Artificial Sequence; identical to SEQ ID NO: 10040
  hemagglutinin__InfluenzaA__AHL98449

SEQ ID NO: 11622 - protein, 566 aa, Artificial Sequence
  hemagglutinin__InfluenzaA__AHL98471
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFEKFEIFPKTSSWPNHDSNKGVTAACPHAGAKSFYKNLIWLVKKGNSYPKLRESYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11623 - protein, 566 aa, Artificial Sequence; identical to SEQ ID NO: 9994
  hemagglutinin__InfluenzaA__AHL98482

SEQ ID NO: 11624 - protein, 566 aa, Artificial Sequence; identical to SEQ ID NO: 9835
  hemagglutinin__InfluenzaA__AHL98494

SEQ ID NO: 11625 - protein, 566 aa, Artificial Sequence; identical to SEQ ID NO: 9994
  hemagglutinin__InfluenzaA__AHL98506

SEQ ID NO: 11626 - protein, 566 aa, Artificial Sequence; identical to SEQ ID NO: 9994
  hemagglutinin__InfluenzaA__AHL98518

SEQ ID NO: 11627 - protein, 566 aa, Artificial Sequence; identical to SEQ ID NO: 9835
  hemagglutinin__InfluenzaA__AHL98530

SEQ ID NO: 11628 - protein, 566 aa, Artificial Sequence; identical to SEQ ID NO: 9994
  hemagglutinin__InfluenzaA__AHL98542

SEQ ID NO: 11629 - protein, 566 aa, Artificial Sequence; identical to SEQ ID NO: 9994
  hemagglutinin__InfluenzaA__AHL98554

SEQ ID NO: 11630 - protein, 566 aa, Artificial Sequence; identical to SEQ ID NO: 9868
  hemagglutinin__InfluenzaA__AHL98566

SEQ ID NO: 11631 - protein, 566 aa, Artificial Sequence; identical to SEQ ID NO: 9868
  hemagglutinin__InfluenzaA__AHL98578

SEQ ID NO: 11632 - protein, 566 aa, Artificial Sequence; identical to SEQ ID NO: 9994
  hemagglutinin__InfluenzaA__AHL98590

SEQ ID NO: 11633 - protein, 566 aa, Artificial Sequence; identical to SEQ ID NO: 9858
  hemagglutinin__InfluenzaA__AHL98602

SEQ ID NO: 11634 - protein, 566 aa, Artificial Sequence; identical to SEQ ID NO: 9835
  hemagglutinin__InfluenzaA__AHL98614

SEQ ID NO: 11635 - protein, 566 aa, Artificial Sequence
  hemagglutinin__InfluenzaA__AHL98626
MKTIIALSYILCLVFAQELPGNDDSTATLCLGHHAVPNGTIVKTITNDQIEVTNATELVQSSSTGEICNSPHQILDGENCTLIDALLGDPQCDGFQNKRWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11636 - protein, 566 aa, Artificial Sequence; identical to SEQ ID NO: 9858
  hemagglutinin__InfluenzaA__AHL98638

SEQ ID NO: 11637 - protein, 566 aa, Artificial Sequence; identical to SEQ ID NO: 9868
  hemagglutinin__InfluenzaA__AHL98650

SEQ ID NO: 11638 - protein, 566 aa, Artificial Sequence
  hemagglutinin__InfluenzaA__AHL98662
MKTIIALSYILCLVFAQKLPGNDNSTATLCLGHHAVPNGTMVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11639 - protein, 566 aa, Artificial Sequence; identical to SEQ ID NO: 11506
  hemagglutinin__InfluenzaA__AHL98674

SEQ ID NO: 11640 - protein, 566 aa, Artificial Sequence; identical to SEQ ID NO: 9858
  hemagglutinin__InfluenzaA__AHL98686

SEQ ID NO: 11641 - protein, 566 aa, Artificial Sequence; identical to SEQ ID NO: 9994
  hemagglutinin__InfluenzaA__AHL98699

SEQ ID NO: 11642 - protein, 566 aa, Artificial Sequence; identical to SEQ ID NO: 10123
  hemagglutinin__InfluenzaA__AHL98711

SEQ ID NO: 11643 - protein, 566 aa, Artificial Sequence; identical to SEQ ID NO: 10467
  hemagglutinin__InfluenzaA__AHL98722

SEQ ID NO: 11644 - protein, 566 aa, Artificial Sequence; identical to SEQ ID NO: 9868
  hemagglutinin__InfluenzaA__AHL98734

SEQ ID NO: 11645 - protein, 566 aa, Artificial Sequence; identical to SEQ ID NO: 9994
  hemagglutinin__InfluenzaA__AHL98746

SEQ ID NO: 11646 - protein, 566 aa, Artificial Sequence; identical to SEQ ID NO: 9868
  hemagglutinin__InfluenzaA__AHL98758

SEQ ID NO: 11647 - protein, 566 aa, Artificial Sequence; identical to SEQ ID NO: 9858
  hemagglutinin__InfluenzaA__AHL98770

SEQ ID NO: 11648 - protein, 566 aa, Artificial Sequence; identical to SEQ ID NO: 9997
  hemagglutinin__InfluenzaA__AHL98782

SEQ ID NO: 11649 - protein, 566 aa, Artificial Sequence
  hemagglutinin__InfluenzaA__AHL98794
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCRSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11650 - protein, 566 aa, Artificial Sequence
  hemagglutinin__InfluenzaA__AHL98806
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQTAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11651 - protein, 566 aa, Artificial Sequence; identical to SEQ ID NO: 9858
  hemagglutinin__InfluenzaA__AHL98818

SEQ ID NO: 11652 - protein, 566 aa, Artificial Sequence; identical to SEQ ID NO: 9868
  hemagglutinin__InfluenzaA__AHL98830

SEQ ID NO: 11653 - protein, 566 aa, Artificial Sequence; identical to SEQ ID NO: 9858
  hemagglutinin__InfluenzaA__AHL98842

SEQ ID NO: 11654 - protein, 566 aa, Artificial Sequence; identical to SEQ ID NO: 9858
  hemagglutinin__InfluenzaA__AHL98854

SEQ ID NO: 11655 - protein, 566 aa, Artificial Sequence
  hemagglutinin__InfluenzaA__AHL98878
MKTIIALSYILCLVFTQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11656 - protein, 566 aa, Artificial Sequence
  hemagglutinin__InfluenzaA__AHL98890
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCLLLCVALLGFIMWACQKGNIRCNICI

SEQ ID NO: 11657 - protein, 566 aa, Artificial Sequence
  hemagglutinin__InfluenzaA__AHL98902
MKTIIALSYILCLVFAQKLPGNDNSTATLCLGHHAVPNGTVVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11658 - protein, 566 aa, Artificial Sequence; identical to SEQ ID NO: 9868
  hemagglutinin__InfluenzaA__AHL98913

SEQ ID NO: 11659 - protein, 566 aa, Artificial Sequence; identical to SEQ ID NO: 9858
  hemagglutinin__InfluenzaA__AHL98925

SEQ ID NO: 11660 - protein, 566 aa, Artificial Sequence; identical to SEQ ID NO: 9997
  hemagglutinin__InfluenzaA__AHL98937

SEQ ID NO: 11661 - protein, 566 aa, Artificial Sequence; identical to SEQ ID NO: 9994
  hemagglutinin__InfluenzaA__AHL98961

SEQ ID NO: 11662 - protein, 566 aa, Artificial Sequence
  hemagglutinin__InfluenzaA__AHL98973
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVVPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAMSCFLLCVALLGFIMWACQKGNIRCNICI

SEQ ID NO: 11663 - protein, 566 aa, Artificial Sequence
  hemagglutinin__InfluenzaA__AHL98985
MKTIIALSYILCLVFAQKLPGNDNSTATLCLGHHAVPNGTIVKTITNDRIEVTNATELVQNSSIGEICDSPHQILDGENCTIIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11664 - protein, 566 aa, Artificial Sequence; identical to SEQ ID NO: 9994
  hemagglutinin__InfluenzaA__AHL98997

SEQ ID NO: 11665 - protein, 566 aa, Artificial Sequence; identical to SEQ ID NO: 9858
  hemagglutinin__InfluenzaA__AHL99009

SEQ ID NO: 11666 - protein, 566 aa, Artificial Sequence; identical to SEQ ID NO: 9868
  hemagglutinin__InfluenzaA__AHL99021

SEQ ID NO: 11667 - protein, 566 aa, Artificial Sequence
  hemagglutinin__InfluenzaA__AHL99045
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGPCPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11668 - protein, 566 aa, Artificial Sequence
  hemagglutinin__InfluenzaA__AHL99057
MKTIIALSYILCLVFAQKLPGNDNSTATLCLGHHAVPNGTIVKTITNDRIEVTNATELVQNSSIGEICDSPHQIIDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11669 - protein, 566 aa, Artificial Sequence
  hemagglutinin__InfluenzaA__AHL99069
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDTLLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11670 - protein, 566 aa, Artificial Sequence
  hemagglutinin__InfluenzaA__AHL99081
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQGTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11671 - protein, 566 aa, Artificial Sequence
  hemagglutinin__InfluenzaA__AHL99093
MKTIIALSYILCLIFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIKCNICI

SEQ ID NO: 11672 - protein, 566 aa, Artificial Sequence; identical to SEQ ID NO: 9858
  hemagglutinin__InfluenzaA__AHL99117

SEQ ID NO: 11673 - protein, 566 aa, Artificial Sequence
  hemagglutinin__InfluenzaA__AHL99129
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDIEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIIWACQKGNIRCNICI

SEQ ID NO: 11674 - protein, 566 aa, Artificial Sequence
  hemagglutinin__InfluenzaA__AHL99141
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLDFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11675 - protein, 566 aa, Artificial Sequence
  hemagglutinin__InfluenzaA__AHL99153
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVTPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11676 - protein, 566 aa, Artificial Sequence; identical to SEQ ID NO: 9997
  hemagglutinin__InfluenzaA__AHL99165

SEQ ID NO: 11677 - protein, 566 aa, Artificial Sequence; identical to SEQ ID NO: 10482
  hemagglutinin__InfluenzaA__AHL99177

SEQ ID NO: 11678 - protein, 566 aa, Artificial Sequence; identical to SEQ ID NO: 9858
  hemagglutinin__InfluenzaA__AHL99189

SEQ ID NO: 11679 - protein, 566 aa, Artificial Sequence; identical to SEQ ID NO: 9994
  hemagglutinin__InfluenzaA__AHL99225

SEQ ID NO: 11680 - protein, 566 aa, Artificial Sequence; identical to SEQ ID NO: 10467
  hemagglutinin__InfluenzaA__AHL99237

SEQ ID NO: 11681 - protein, 566 aa, Artificial Sequence; identical to SEQ ID NO: 9868
  hemagglutinin__InfluenzaA__AHL99249

SEQ ID NO: 11682 - protein, 566 aa, Artificial Sequence; identical to SEQ ID NO: 9858
  hemagglutinin__InfluenzaA__AHL99261

SEQ ID NO: 11683 - protein, 566 aa, Artificial Sequence; identical to SEQ ID NO: 9997
  hemagglutinin__InfluenzaA__AHL99273

SEQ ID NO: 11684 - protein, 566 aa, Artificial Sequence
  hemagglutinin__InfluenzaA__AHL99285
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIQSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11685 - protein, 566 aa, Artificial Sequence; identical to SEQ ID NO: 10023
  hemagglutinin__InfluenzaA__AHL99297

SEQ ID NO: 11686 - protein, 566 aa, Artificial Sequence; identical to SEQ ID NO: 9868
  hemagglutinin__InfluenzaA__AHL99309

SEQ ID NO: 11687 - protein, 566 aa, Artificial Sequence
  hemagglutinin__InfluenzaA__AHL99321
MKTIIALSYILCLVFTQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11688 - protein, 566 aa, Artificial Sequence
  hemagglutinin__InfluenzaA__AHL99333
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11689 - protein, 566 aa, Artificial Sequence
  hemagglutinin__InfluenzaA__AHL99356
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSKYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11690 - protein, 566 aa, Artificial Sequence; identical to SEQ ID NO: 9883
  hemagglutinin__InfluenzaA__AHL99367

SEQ ID NO: 11691 - protein, 566 aa, Artificial Sequence
  hemagglutinin__InfluenzaA__AHL99379
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPHAGAKGFYKNLIWLVKKGNSYPKLSISYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTAASSLVLVVSLGAISFWMCSNGSLQCRICI

SEQ ID NO: 11692 - protein, 566 aa, Artificial Sequence; identical to SEQ ID NO: 11684
  hemagglutinin__InfluenzaA__AHL99390

SEQ ID NO: 11693 - protein, 566 aa, Artificial Sequence; identical to SEQ ID NO: 9858
  hemagglutinin__InfluenzaA__AHL99402

SEQ ID NO: 11694 - protein, 566 aa, Artificial Sequence
  hemagglutinin__InfluenzaA__AHL99426
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSMMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11695 - protein, 566 aa, Artificial Sequence
  hemagglutinin__InfluenzaA__AHL99438
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIQSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11696 - protein, 566 aa, Artificial Sequence; identical to SEQ ID NO: 9994
  hemagglutinin__InfluenzaA__AHL99450

SEQ ID NO: 11697 - protein, 566 aa, Artificial Sequence; identical to SEQ ID NO: 10467
  hemagglutinin__InfluenzaA__AHL99462

SEQ ID NO: 11698 - protein, 566 aa, Artificial Sequence; identical to SEQ ID NO: 9997
  hemagglutinin__InfluenzaA__AHL99474

SEQ ID NO: 11699 - protein, 566 aa, Artificial Sequence; identical to SEQ ID NO: 10023
  hemagglutinin__InfluenzaA__AHL99486

SEQ ID NO: 11700 - protein, 566 aa, Artificial Sequence; identical to SEQ ID NO: 9994
  hemagglutinin__InfluenzaA__AHL99498

SEQ ID NO: 11701 - protein, 566 aa, Artificial Sequence; identical to SEQ ID NO: 9858
  hemagglutinin__InfluenzaA__AHL99510

SEQ ID NO: 11702 - protein, 566 aa, Artificial Sequence; identical to SEQ ID NO: 9858
  hemagglutinin__InfluenzaA__AHL99522

SEQ ID NO: 11703 - protein, 566 aa, Artificial Sequence; identical to SEQ ID NO: 9883
  hemagglutinin__InfluenzaA__AHL99534

SEQ ID NO: 11704 - protein, 566 aa, Artificial Sequence; identical to SEQ ID NO: 9858
  hemagglutinin__InfluenzaA__AHL99546

SEQ ID NO: 11705 - protein, 566 aa, Artificial Sequence; identical to SEQ ID NO: 9858
  hemagglutinin__InfluenzaA__AHL99558

SEQ ID NO: 11706 - protein, 566 aa, Artificial Sequence
  hemagglutinin__InfluenzaA__AHL99570
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSSCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYIKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11707 - protein, 566 aa, Artificial Sequence; identical to SEQ ID NO: 9858
  hemagglutinin__InfluenzaA__AHL99582

SEQ ID NO: 11708 - protein, 566 aa, Artificial Sequence
  hemagglutinin__InfluenzaA__AHL99594
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPRAGAKGFYKNLIWLVKKGNSYPKLSISYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 11709 - protein, 566 aa, Artificial Sequence; identical to SEQ ID NO: 10467
  hemagglutinin__InfluenzaA__AHL99605

SEQ ID NO: 11710 - protein, 566 aa, Artificial Sequence; identical to SEQ ID NO: 9997
  hemagglutinin__InfluenzaA__AHL99617

SEQ ID NO: 11711 - protein, 566 aa, Artificial Sequence; identical to SEQ ID NO: 9858
  hemagglutinin__InfluenzaA__AHL99629

SEQ ID NO: 11712 - protein, 566 aa, Artificial Sequence
  hemagglutinin__InfluenzaA__AHL99641
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVVPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAMSCFLLCVALLGFIMWACQKGNIRCNICI

SEQ ID NO: 11713 - protein, 566 aa, Artificial Sequence
  hemagglutinin__InfluenzaA__AHL99665
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYIKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11714 - protein, 566 aa, Artificial Sequence; identical to SEQ ID NO: 9858
  hemagglutinin__InfluenzaA__AHL99677

SEQ ID NO: 11715 - protein, 566 aa, Artificial Sequence; identical to SEQ ID NO: 9858
  hemagglutinin__InfluenzaA__AHL99689

SEQ ID NO: 11716 - protein, 566 aa, Artificial Sequence
  hemagglutinin__InfluenzaA__AHL99701
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVTPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11717 - protein, 566 aa, Artificial Sequence
  hemagglutinin__InfluenzaA__AHL99713
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYTSLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAITCFLLCVALLGFIMWACQKGNIRCNICI

SEQ ID NO: 11718 - protein, 566 aa, Artificial Sequence; identical to SEQ ID NO: 9858
  hemagglutinin__InfluenzaA__AHL99725

SEQ ID NO: 11719 - protein, 566 aa, Artificial Sequence; identical to SEQ ID NO: 10060
  hemagglutinin__InfluenzaA__AHL99737

SEQ ID NO: 11720 - protein, 566 aa, Artificial Sequence; identical to SEQ ID NO: 9858
  hemagglutinin__InfluenzaA__AHL99748

SEQ ID NO: 11721 - protein, 566 aa, Artificial Sequence; identical to SEQ ID NO: 9858
  hemagglutinin__InfluenzaA__AHL99760

SEQ ID NO: 11722 - protein, 566 aa, Artificial Sequence; identical to SEQ ID NO: 9868
  hemagglutinin__InfluenzaA__AHL99772

SEQ ID NO: 11723 - protein, 566 aa, Artificial Sequence; identical to SEQ ID NO: 9883
  hemagglutinin__InfluenzaA__AHL99784

SEQ ID NO: 11724 - protein, 566 aa, Artificial Sequence; identical to SEQ ID NO: 10023
  hemagglutinin__InfluenzaA__AHL99796

SEQ ID NO: 11725 - protein, 566 aa, Artificial Sequence; identical to SEQ ID NO: 9858
  hemagglutinin__InfluenzaA__AHL99808

SEQ ID NO: 11726 - protein, 566 aa, Artificial Sequence
  hemagglutinin__InfluenzaA__AHL99820
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSDGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 11727 - protein, 566 aa, Artificial Sequence; identical to SEQ ID NO: 9858
  hemagglutinin__InfluenzaA__AHL99832

SEQ ID NO: 11728 - protein, 566 aa, Artificial Sequence; identical to SEQ ID NO: 9883
  hemagglutinin__InfluenzaA__AHL99844

SEQ ID NO: 11729 - protein, 566 aa, Artificial Sequence; identical to SEQ ID NO: 9835
  hemagglutinin__InfluenzaA__AHL99856

SEQ ID NO: 11730 - protein, 566 aa, Artificial Sequence
  hemagglutinin__InfluenzaA__AHL99868
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11731 - protein, 566 aa, Artificial Sequence; identical to SEQ ID NO: 9997
  hemagglutinin__InfluenzaA__AHL99880

SEQ ID NO: 11732 - protein, 566 aa, Artificial Sequence; identical to SEQ ID NO: 9858
  hemagglutinin__InfluenzaA__AHL99892

SEQ ID NO: 11733 - protein, 566 aa, Artificial Sequence; identical to SEQ ID NO: 9994
  hemagglutinin__InfluenzaA__AHL99904

SEQ ID NO: 11734 - protein, 566 aa, Artificial Sequence
  hemagglutinin__InfluenzaA__AHL99916
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKMRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11735 - protein, 566 aa, Artificial Sequence; identical to SEQ ID NO: 9883
  hemagglutinin__InfluenzaA__AHL99928

SEQ ID NO: 11736 - protein, 566 aa, Artificial Sequence
  hemagglutinin__InfluenzaA__AHL99940
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSGVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11737 - protein, 566 aa, Artificial Sequence; identical to SEQ ID NO: 9858
  hemagglutinin__InfluenzaA__AHL99952

SEQ ID NO: 11738 - protein, 566 aa, Artificial Sequence; identical to SEQ ID NO: 9883
  hemagglutinin__InfluenzaA__AHL99964

SEQ ID NO: 11739 - protein, 566 aa, Artificial Sequence; identical to SEQ ID NO: 9883
  hemagglutinin__InfluenzaA__AHL99976

SEQ ID NO: 11740 - protein, 566 aa, Artificial Sequence; identical to SEQ ID NO: 9883
  hemagglutinin__InfluenzaA__AHL99988

SEQ ID NO: 11741 - protein, 566 aa, Artificial Sequence; identical to SEQ ID NO: 9858
  hemagglutinin__InfluenzaA__AHM00001

SEQ ID NO: 11742 - protein, 566 aa, Artificial Sequence; identical to SEQ ID NO: 9858
  hemagglutinin__InfluenzaA__AHM00013

SEQ ID NO: 11743 - protein, 566 aa, Artificial Sequence; identical to SEQ ID NO: 9868
  hemagglutinin__InfluenzaA__AHM00025

SEQ ID NO: 11744 - protein, 566 aa, Artificial Sequence; identical to SEQ ID NO: 9883
  hemagglutinin__InfluenzaA__AHM00037

SEQ ID NO: 11745 - protein, 566 aa, Artificial Sequence; identical to SEQ ID NO: 9883
  hemagglutinin__InfluenzaA__AHM00061

SEQ ID NO: 11746 - protein, 566 aa, Artificial Sequence; identical to SEQ ID NO: 9858
  hemagglutinin__InfluenzaA__AHM00073

SEQ ID NO: 11747 - protein, 566 aa, Artificial Sequence; identical to SEQ ID NO: 9858
  hemagglutinin__InfluenzaA__AHM00085

SEQ ID NO: 11748 - protein, 566 aa, Artificial Sequence
  hemagglutinin__InfluenzaA__AHM00097
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSNSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTTVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNMCMESVKNGTYDYPKYSEEAKLNREKIDGVKLESTRIYQILAIYSTVASSLVLVVSLGAISFWMCSNGSLQCRICI

SEQ ID NO: 11749 - protein, 566 aa, Artificial Sequence; identical to SEQ ID NO: 9883
  hemagglutinin__InfluenzaA__AHM00108

SEQ ID NO: 11750 - protein, 566 aa, Artificial Sequence; identical to SEQ ID NO: 9883
  hemagglutinin__InfluenzaA__AHM00120

SEQ ID NO: 11751 - protein, 566 aa, Artificial Sequence
  hemagglutinin__InfluenzaA__AHM00132
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQISLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11752 - protein, 566 aa, Artificial Sequence; identical to SEQ ID NO: 9858
  hemagglutinin__InfluenzaA__AHM00144

SEQ ID NO: 11753 - protein, 566 aa, Artificial Sequence; identical to SEQ ID NO: 9883
  hemagglutinin__InfluenzaA__AHM00156

SEQ ID NO: 11754 - protein, 566 aa, Artificial Sequence; identical to SEQ ID NO: 9858
  hemagglutinin__InfluenzaA__AHM00168

SEQ ID NO: 11755 - protein, 566 aa, Artificial Sequence
  hemagglutinin__InfluenzaA__AHM00180
MKTIIALSYILCLVFAQKLPGNDNSTATLCLGHHAVPNGTIVKTITNDRIEVTNATELVQNSSIGEICDNPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11756 - protein, 566 aa, Artificial Sequence; identical to SEQ ID NO: 9835
  hemagglutinin__InfluenzaA__AHM00192

SEQ ID NO: 11757 - protein, 566 aa, Artificial Sequence; identical to SEQ ID NO: 9883
  hemagglutinin__InfluenzaA__AHM00204

SEQ ID NO: 11758 - protein, 566 aa, Artificial Sequence; identical to SEQ ID NO: 9883
  hemagglutinin__InfluenzaA__AHM00216

SEQ ID NO: 11759 - protein, 566 aa, Artificial Sequence; identical to SEQ ID NO: 9858
  hemagglutinin__InfluenzaA__AHM00228

SEQ ID NO: 11760 - protein, 566 aa, Artificial Sequence; identical to SEQ ID NO: 9858
  hemagglutinin__InfluenzaA__AHM00240

SEQ ID NO: 11761 - protein, 566 aa, Artificial Sequence; identical to SEQ ID NO: 9858
  hemagglutinin__InfluenzaA__AHM00252

SEQ ID NO: 11762 - protein, 566 aa, Artificial Sequence; identical to SEQ ID NO: 9858
  hemagglutinin__InfluenzaA__AHM00264

SEQ ID NO: 11763 - protein, 566 aa, Artificial Sequence; identical to SEQ ID NO: 9835
  hemagglutinin__InfluenzaA__AHM00276

SEQ ID NO: 11764 - protein, 566 aa, Artificial Sequence; identical to SEQ ID NO: 9858
  hemagglutinin__InfluenzaA__AHM00288

SEQ ID NO: 11765 - protein, 566 aa, Artificial Sequence; identical to SEQ ID NO: 9858
  hemagglutinin__InfluenzaA__AHM00300

SEQ ID NO: 11766 - protein, 566 aa, Artificial Sequence; identical to SEQ ID NO: 9883
  hemagglutinin__InfluenzaA__AHM00312

SEQ ID NO: 11767 - protein, 566 aa, Artificial Sequence; identical to SEQ ID NO: 9835
  hemagglutinin__InfluenzaA__AHM00324

SEQ ID NO: 11768 - protein, 566 aa, Artificial Sequence; identical to SEQ ID NO: 9835
  hemagglutinin__InfluenzaA__AHM00336

SEQ ID NO: 11769 - protein, 566 aa, Artificial Sequence; identical to SEQ ID NO: 9883
  hemagglutinin__InfluenzaA__AHM00348

SEQ ID NO: 11770 - protein, 566 aa, Artificial Sequence
  hemagglutinin__InfluenzaA__AHM00360
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11771 - protein, 566 aa, Artificial Sequence; identical to SEQ ID NO: 9883
  hemagglutinin__InfluenzaA__AHM00372

SEQ ID NO: 11772 - protein, 566 aa, Artificial Sequence; identical to SEQ ID NO: 9883
  hemagglutinin__InfluenzaA__AHM00395

SEQ ID NO: 11773 - protein, 566 aa, Artificial Sequence; identical to SEQ ID NO: 9858
  hemagglutinin__InfluenzaA__AHM00407

SEQ ID NO: 11774 - protein, 566 aa, Artificial Sequence; identical to SEQ ID NO: 9858
  hemagglutinin__InfluenzaA__AHM00419

SEQ ID NO: 11775 - protein, 566 aa, Artificial Sequence; identical to SEQ ID NO: 9858
  hemagglutinin__InfluenzaA__AHM00443

SEQ ID NO: 11776 - protein, 566 aa, Artificial Sequence; identical to SEQ ID NO: 9883
  hemagglutinin__InfluenzaA__AHM00455

SEQ ID NO: 11777 - protein, 566 aa, Artificial Sequence; identical to SEQ ID NO: 9883
  hemagglutinin__InfluenzaA__AHM00467

SEQ ID NO: 11778 - protein, 566 aa, Artificial Sequence; identical to SEQ ID NO: 9883
  hemagglutinin__InfluenzaA__AHM00479

SEQ ID NO: 11779 - protein, 566 aa, Artificial Sequence; identical to SEQ ID NO: 9883
  hemagglutinin__InfluenzaA__AHM00491

SEQ ID NO: 11780 - protein, 566 aa, Artificial Sequence; identical to SEQ ID NO: 9858
  hemagglutinin__InfluenzaA__AHM00503

SEQ ID NO: 11781 - protein, 566 aa, Artificial Sequence; identical to SEQ ID NO: 9858
  hemagglutinin__InfluenzaA__AHM00515

SEQ ID NO: 11782 - protein, 566 aa, Artificial Sequence
  hemagglutinin__InfluenzaA__AHM00527
MKTIIALSYILCLVFAQKLPGNDNSTATLCLGHHAVPNGTIVKTITNDRIEVTNATELVQNSPIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11783 - protein, 566 aa, Artificial Sequence; identical to SEQ ID NO: 9835
  hemagglutinin__InfluenzaA__AHM00539

SEQ ID NO: 11784 - protein, 566 aa, Artificial Sequence
  hemagglutinin__InfluenzaA__AHM00543
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTMEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11785 - protein, 566 aa, Artificial Sequence; identical to SEQ ID NO: 9858
  hemagglutinin__InfluenzaA__AHM00555

SEQ ID NO: 11786 - protein, 566 aa, Artificial Sequence
  hemagglutinin__InfluenzaA__AHM00567
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11787 - protein, 566 aa, Artificial Sequence; identical to SEQ ID NO: 9858
  hemagglutinin__InfluenzaA__AHM00579

SEQ ID NO: 11788 - protein, 566 aa, Artificial Sequence; identical to SEQ ID NO: 9883
  hemagglutinin__InfluenzaA__AHM00591

SEQ ID NO: 11789 - protein, 566 aa, Artificial Sequence; identical to SEQ ID NO: 9858
  hemagglutinin__InfluenzaA__AHM00603

SEQ ID NO: 11790 - protein, 566 aa, Artificial Sequence; identical to SEQ ID NO: 9858
  hemagglutinin__InfluenzaA__AHM00615

SEQ ID NO: 11791 - protein, 566 aa, Artificial Sequence
  hemagglutinin__InfluenzaA__AHM00627
MKTTIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 11792 - protein, 566 aa, Artificial Sequence; identical to SEQ ID NO: 9858
  hemagglutinin__InfluenzaA__AHM00639

SEQ ID NO: 11793 - protein, 566 aa, Artificial Sequence; identical to SEQ ID NO: 9835
  hemagglutinin__InfluenzaA__AHM00651

SEQ ID NO: 11794 - protein, 566 aa, Artificial Sequence; identical to SEQ ID NO: 9994
  hemagglutinin__InfluenzaA__AHM00663

SEQ ID NO: 11795 - protein, 566 aa, Artificial Sequence; identical to SEQ ID NO: 9883
  hemagglutinin__InfluenzaA__AHM00675

SEQ ID NO: 11796 - protein, 566 aa, Artificial Sequence; identical to SEQ ID NO: 10945
  hemagglutinin__InfluenzaA__AHM00687

SEQ ID NO: 11797 - protein, 566 aa, Artificial Sequence
  hemagglutinin__InfluenzaA__AHM00698
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACTRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11798 - protein, 566 aa, Artificial Sequence; identical to SEQ ID NO: 9858
  hemagglutinin__InfluenzaA__AHM00710

SEQ ID NO: 11799 - protein, 566 aa, Artificial Sequence; identical to SEQ ID NO: 9858
  hemagglutinin__InfluenzaA__AHM00722

SEQ ID NO: 11800 - protein, 566 aa, Artificial Sequence; identical to SEQ ID NO: 9858
  hemagglutinin__InfluenzaA__AHM00734

SEQ ID NO: 11801 - protein, 566 aa, Artificial Sequence; identical to SEQ ID NO: 9993
  hemagglutinin__InfluenzaA__AHM00746

SEQ ID NO: 11802 - protein, 566 aa, Artificial Sequence; identical to SEQ ID NO: 9858
  hemagglutinin__InfluenzaA__AHM00758

SEQ ID NO: 11803 - protein, 566 aa, Artificial Sequence; identical to SEQ ID NO: 10026
  hemagglutinin__InfluenzaA__AHM00770

SEQ ID NO: 11804 - protein, 566 aa, Artificial Sequence; identical to SEQ ID NO: 9835
  hemagglutinin__InfluenzaA__AHM00782

SEQ ID NO: 11805 - protein, 566 aa, Artificial Sequence
  hemagglutinin__InfluenzaA__AHM00794
MKTIIALSYILCLVFTQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11806 - protein, 566 aa, Artificial Sequence; identical to SEQ ID NO: 10026
  hemagglutinin__InfluenzaA__AHM00806

SEQ ID NO: 11807 - protein, 566 aa, Artificial Sequence
  hemagglutinin__InfluenzaA__AHM00818
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNENFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11808 - protein, 566 aa, Artificial Sequence; identical to SEQ ID NO: 9883
  hemagglutinin__InfluenzaA__AHM00830

SEQ ID NO: 11809 - protein, 566 aa, Artificial Sequence; identical to SEQ ID NO: 9883
  hemagglutinin__InfluenzaA__AHM00842

SEQ ID NO: 11810 - protein, 566 aa, Artificial Sequence; identical to SEQ ID NO: 11786
  hemagglutinin__InfluenzaA__AHM00854

SEQ ID NO: 11811 - protein, 566 aa, Artificial Sequence; identical to SEQ ID NO: 11786
  hemagglutinin__InfluenzaA__AHM00866

SEQ ID NO: 11812 - protein, 566 aa, Artificial Sequence; identical to SEQ ID NO: 9858
  hemagglutinin__InfluenzaA__AHM00878

SEQ ID NO: 11813 - protein, 566 aa, Artificial Sequence; identical to SEQ ID NO: 9835
  hemagglutinin__InfluenzaA__AHM00890

SEQ ID NO: 11814 - protein, 566 aa, Artificial Sequence; identical to SEQ ID NO: 9868
  hemagglutinin__InfluenzaA__AHM00902

SEQ ID NO: 11815 - protein, 566 aa, Artificial Sequence; identical to SEQ ID NO: 9858
  hemagglutinin__InfluenzaA__AHM00914

SEQ ID NO: 11816 - protein, 566 aa, Artificial Sequence; identical to SEQ ID NO: 9858
  hemagglutinin__InfluenzaA__AHM00926

SEQ ID NO: 11817 - protein, 566 aa, Artificial Sequence; identical to SEQ ID NO: 9835
  hemagglutinin__InfluenzaA__AHM00938

SEQ ID NO: 11818 - protein, 566 aa, Artificial Sequence
  hemagglutinin__InfluenzaA__AHM00950
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYVSLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAMSCFLLCVALLGFIMWACQKGNIRCNICI

SEQ ID NO: 11819 - protein, 566 aa, Artificial Sequence; identical to SEQ ID NO: 9835
  hemagglutinin__InfluenzaA__AHM00962

SEQ ID NO: 11820 - protein, 566 aa, Artificial Sequence
  hemagglutinin__InfluenzaA__AHM00974
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGGITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11821 - protein, 560 aa, Artificial Sequence
  hemagglutinin__InfluenzaA__AHM24224
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVKEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 11822 - protein, 560 aa, Artificial Sequence; identical to SEQ ID NO: 9988
  hemagglutinin__InfluenzaA__AHM24236

SEQ ID NO: 11823 - protein, 560 aa, Artificial Sequence; identical to SEQ ID NO: 9988
  hemagglutinin__InfluenzaA__AHM24248

SEQ ID NO: 11824 - protein, 566 aa, Artificial Sequence
  hemagglutinin__InfluenzaA__AHM98309
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEVFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11825 - protein, 569 aa, Artificial Sequence
  hemagglutinin__InfluenzaA__AHM98339
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11826 - protein, 566 aa, Artificial Sequence
  hemagglutinin__InfluenzaA__AHM98350
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDANKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11827 - protein, 566 aa, Artificial Sequence; identical to SEQ ID NO: 6454
  hemagglutinin__InfluenzaA__AHM98361

SEQ ID NO: 11828 - protein, 566 aa, Artificial Sequence; identical to SEQ ID NO: 6867
  hemagglutinin__InfluenzaA__AHM98372

SEQ ID NO: 11829 - protein, 566 aa, Artificial Sequence; identical to SEQ ID NO: 6867
  hemagglutinin__InfluenzaA__AHM98383

SEQ ID NO: 11830 - protein, 566 aa, Artificial Sequence; identical to SEQ ID NO: 6824
  hemagglutinin__InfluenzaA__AHM98394

SEQ ID NO: 11831 - protein, 566 aa, Artificial Sequence
  hemagglutinin__InfluenzaA__AHM98405
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFKRFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11832 - protein, 566 aa, Artificial Sequence; identical to SEQ ID NO: 11831
  hemagglutinin__InfluenzaA__AHM98416

SEQ ID NO: 11833 - protein, 566 aa, Artificial Sequence; identical to SEQ ID NO: 6824
  hemagglutinin__InfluenzaA__AHM98427

SEQ ID NO: 11834 - protein, 566 aa, Artificial Sequence; identical to SEQ ID NO: 7042
  hemagglutinin__InfluenzaA__AHM98438

SEQ ID NO: 11835 - protein, 566 aa, Artificial Sequence; identical to SEQ ID NO: 8186
  hemagglutinin__InfluenzaA__AHM98449

SEQ ID NO: 11836 - protein, 566 aa, Artificial Sequence
  hemagglutinin__InfluenzaA__AHM98460
MKAILVVLLCTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTTVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11837 - protein, 566 aa, Artificial Sequence; identical to SEQ ID NO: 6867
  hemagglutinin__InfluenzaA__AHM98471

SEQ ID NO: 11838 - protein, 566 aa, Artificial Sequence
  hemagglutinin__InfluenzaA__AHM98482
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIDKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11839 - protein, 566 aa, Artificial Sequence
  hemagglutinin__InfluenzaA__AHM98493
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKYPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11840 - protein, 566 aa, Artificial Sequence
  hemagglutinin__InfluenzaA__AHM98504
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSKEAKLNREEIDGVKLESTRIYQILAIYSTVASSLVLVVSLGAISFWMCSNGSLQCRICI

SEQ ID NO: 11841 - protein, 566 aa, Artificial Sequence; identical to SEQ ID NO: 6454
  hemagglutinin__InfluenzaA__AHM98515

SEQ ID NO: 11842 - protein, 566 aa, Artificial Sequence
  hemagglutinin__InfluenzaA__AHM98526
MKAILVVLLHTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLRSTQNAIDKITNKVNSVIEKMNTQFTAVGKEFNHLEKRIENLNKKVDDGFLDIWTYNAELLILLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11843 - protein, 566 aa, Artificial Sequence; identical to SEQ ID NO: 6454
  hemagglutinin__InfluenzaA__AHM98537

SEQ ID NO: 11844 - protein, 566 aa, Artificial Sequence
  hemagglutinin__InfluenzaA__AHM98548
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPVTIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11845 - protein, 566 aa, Artificial Sequence
  hemagglutinin__InfluenzaA__AHM98559
MKAILVVLLYTFATAKADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11846 - protein, 566 aa, Artificial Sequence; identical to SEQ ID NO: 6824
  hemagglutinin__InfluenzaA__AHM98570

SEQ ID NO: 11847 - protein, 566 aa, Artificial Sequence
  hemagglutinin__InfluenzaA__AHM98581
MKAILVVLLYTFATANADTLCIGYHANNSTDTVDTVLEKNVTVTHSVNLLEDKHNGKLCKLRGVAPLHLGKCNIAGWILGNPECESLSTARSWSYIVETSSSDNGTCYPGDFIDYEELREQLSSVSSFKRFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11848 - protein, 566 aa, Artificial Sequence; identical to SEQ ID NO: 6824
  hemagglutinin__InfluenzaA__AHM98592

SEQ ID NO: 11849 - protein, 566 aa, Artificial Sequence; identical to SEQ ID NO: 6867
  hemagglutinin__InfluenzaA__AHM98603

SEQ ID NO: 11850 - protein, 566 aa, Artificial Sequence; identical to SEQ ID NO: 6454
  hemagglutinin__InfluenzaA__AHM98614

SEQ ID NO: 11851 - protein, 566 aa, Artificial Sequence; identical to SEQ ID NO: 11831
  hemagglutinin__InfluenzaA__AHM98625

SEQ ID NO: 11852 - protein, 566 aa, Artificial Sequence; identical to SEQ ID NO: 11831
  hemagglutinin__InfluenzaA__AHM98636

SEQ ID NO: 11853 - protein, 566 aa, Artificial Sequence
  hemagglutinin__InfluenzaA__AHM98647
MKAILVVLLYTFATAKADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11854 - protein, 566 aa, Artificial Sequence; identical to SEQ ID NO: 6867
  hemagglutinin__InfluenzaA__AHM98658

SEQ ID NO: 11855 - protein, 566 aa, Artificial Sequence; identical to SEQ ID NO: 6824
  hemagglutinin__InfluenzaA__AHM98669

SEQ ID NO: 11856 - protein, 566 aa, Artificial Sequence; identical to SEQ ID NO: 8186
  hemagglutinin__InfluenzaA__AHM98701

SEQ ID NO: 11857 - protein, 566 aa, Artificial Sequence; identical to SEQ ID NO: 8186
  hemagglutinin__InfluenzaA__AHM98712

SEQ ID NO: 11858 - protein, 566 aa, Artificial Sequence
  hemagglutinin__InfluenzaA__AHM98723
MKAILVVLLYTFATANADTLCIGYHANNSTDTVDTVLEKNVTVTHSVNLLEDKHNGKLCKLRGVAPLHLGNCNIAGWILGNPECESLSTASSWSYIVETSSSDNGTCYPGDFINYEELREQLSSVSSFERFEILPKTSSWPNHDSNKGVTAACPQAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLIEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPRYSEEAKLNREEIDGVKLESTRIYQILAIYSTVASSLVLIVSLGAISFWMCSNGSLQCRICI

SEQ ID NO: 11859 - protein, 566 aa, Artificial Sequence
  hemagglutinin__InfluenzaA__AHM98734
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSNSDNGTCYPGDFIDYEELREQLSSVSSFERFEIFPKTSSWPNHDSNKGVTAACPHAGSKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 11860 - protein, 566 aa, Artificial Sequence; identical to SEQ ID NO: 8186
  hemagglutinin__InfluenzaA__AHM98745

SEQ ID NO: 11861 - protein, 566 aa, Artificial Sequence
  hemagglutinin__InfluenzaA__AHM98756
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIVKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 11862 - protein, 566 aa, Artificial Sequence; identical to SEQ ID NO: 8186
  hemagglutinin__InfluenzaA__AHM98767

SEQ ID NO: 11863 - protein, 566 aa, Artificial Sequence
  hemagglutinin__InfluenzaA__AHM98778
MKAILVVLLYTFATANADTLCIGYHANNSTDTVDTVLEKNVTVTHSVNLLEDKHNRKLCKLRGVAPLHLGKCNIAGWILGNPECESLSTASSWSYIVETSSSDNGTCYPGDFINYEELREQLSSVSSFERFEIFPKTSSWPNHDSNKGVTAACPRAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11864 - protein, 566 aa, Artificial Sequence; identical to SEQ ID NO: 7050
  hemagglutinin__InfluenzaA__AHM98798

SEQ ID NO: 11865 - protein, 566 aa, Artificial Sequence; identical to SEQ ID NO: 6824
  hemagglutinin__InfluenzaA__AHM98809

SEQ ID NO: 11866 - protein, 566 aa, Artificial Sequence; identical to SEQ ID NO: 6824
  hemagglutinin__InfluenzaA__AHM98820

SEQ ID NO: 11867 - protein, 566 aa, Artificial Sequence; identical to SEQ ID NO: 6824
  hemagglutinin__InfluenzaA__AHM98831

SEQ ID NO: 11868 - protein, 566 aa, Artificial Sequence
  hemagglutinin__InfluenzaA__AHM98836
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWILVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11869 - protein, 566 aa, Artificial Sequence
  hemagglutinin__InfluenzaA__AHM98847
MKAILVVMLYTFATANADTLCIGYHANNSTDTVDTVLEKNVTVTHSVNLLEDKHDGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11870 - protein, 566 aa, Artificial Sequence; identical to SEQ ID NO: 6824
  hemagglutinin__InfluenzaA__AHM98858

SEQ ID NO: 11871 - protein, 566 aa, Artificial Sequence; identical to SEQ ID NO: 6867
  hemagglutinin__InfluenzaA__AHM98877

SEQ ID NO: 11872 - protein, 566 aa, Artificial Sequence
  hemagglutinin__InfluenzaA__AHM98898
MKAILVVLLYTFATANADTLCIGYHANNSTDTVDTVLEKNVTVTHSVNLLEDNHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11873 - protein, 566 aa, Artificial Sequence; identical to SEQ ID NO: 10450
  hemagglutinin__InfluenzaA__AHM98909

SEQ ID NO: 11874 - protein, 566 aa, Artificial Sequence
  hemagglutinin__InfluenzaA__AHM98932
MKAILVVLLYTFATANADTLCIGYHANNSTDTVDTVLEKNVTVTHSVNLLEDKHNGKLCKLGGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGDSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11875 - protein, 566 aa, Artificial Sequence; identical to SEQ ID NO: 11874
  hemagglutinin__InfluenzaA__AHM98940

SEQ ID NO: 11876 - protein, 566 aa, Artificial Sequence; identical to SEQ ID NO: 11874
  hemagglutinin__InfluenzaA__AHM98951

SEQ ID NO: 11877 - protein, 566 aa, Artificial Sequence
  hemagglutinin__InfluenzaA__AHM98975
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHESNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11878 - protein, 566 aa, Artificial Sequence
  hemagglutinin__InfluenzaA__AHM98997
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGDSYPKLSKSYINDKGKEVLVLWGIHHPSTSADQQSLYQNADAYVFVGSSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11879 - protein, 566 aa, Artificial Sequence
  hemagglutinin__InfluenzaA__AHM99019
MKAILVVLLYTFATANADTLCIGYHANNSTDTVDTVLEKNVTVTHSVNLLEDKHNGKLCKLKGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGDSYPKLSKSYINDKGKEVLVLWGIHHPSTSADQQSLYQNADAYVFVGSSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11880 - protein, 566 aa, Artificial Sequence; identical to SEQ ID NO: 11879
  hemagglutinin__InfluenzaA__AHM99031

SEQ ID NO: 11881 - protein, 566 aa, Artificial Sequence; identical to SEQ ID NO: 11879
  hemagglutinin__InfluenzaA__AHM99043

SEQ ID NO: 11882 - protein, 566 aa, Artificial Sequence; identical to SEQ ID NO: 11879
  hemagglutinin__InfluenzaA__AHM99054

SEQ ID NO: 11883 - protein, 566 aa, Artificial Sequence; identical to SEQ ID NO: 11879
  hemagglutinin__InfluenzaA__AHM99065

SEQ ID NO: 11884 - protein, 566 aa, Artificial Sequence
  hemagglutinin__InfluenzaA__AHM99075
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGDSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 11885 - protein, 566 aa, Artificial Sequence
  hemagglutinin__InfluenzaA__AHN00717
MKAILLVLLCTFAATNADTLCIGYHANNSTDTVDTVLEKNVTVTHSVNLLEDRHNGKLCKLGGIAPLHLGKCNIAGWLLGNPECELLFTVSSWSYIVETSNSDNGTCYPGDFINYEELREQLSSVSSFERFEIFPKTSSWPNHETNRGVTAACPYAGANSFYRNLIWLVKKGNSYPKLSKSYVNNKGKEVLVLWGIHHPPTSTDQQSLYQNADAYVFVGSSKYNRKFKPEIAARPKVRGQAGRMNYYWTLIEPGDTITFEATGNLVVPRYAFAMNRGPGSGIIISDAPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADQKSTQNAIDGITNKVNSVIKKMNTQFTAVGKEFNHLEKRIENLNKKVDDGFLDVWTYNAELLVLLENERTLDFHDSNVKNLYEKVRSQLRNNAKEIGNGCFEFYHKCDDTCMESVKNGTYDYPKYSEESKLNREEIDGVKLESTRIYQILAIYSTAASSLVLLVSLGAISFWMCSNGSLQCRICI

SEQ ID NO: 11886 - protein, 566 aa, Artificial Sequence
  hemagglutinin__InfluenzaA__AHN00764
MKAILLVLLCTFAATNADTLCIGYHANNSTDTVDTVLEKNVTVTHSVNLLEDKHNGKLCKLGGIAPLHLGKCNIAGWLLGNPECELLFTVSSWSYIVETSNSDNGTCYPGDFINYEELREQLSSVSSFERFEIFPKTSSWPNHETNRGVTAACPYAGANSFYRNLIWLVKKGNSYPKLSKSYVNNKGKEVLVLWGIHHPPTSTDQQSLYQNADAYVFVGSSKYNRKFKPEIAARPKVRGQAGRMNYYWTLIEPGDTITFEATGNLVVPRYAFAMNRGPGSGIIISDAPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADQKSTQNAIDGITNKVNSVIKKMNTQFTAVGKEFNHLEKRIENLNKKVDDGFLDVWTYNAELLVLLENERTLDFHDSNVKNLYEKVRSQLRNNAKEIGNGCFEFYHKCDDTCMESVKNGTYDYPKYSEESKLNREEIDGVKLESTRIYQILAIYSTAASSLVLLVSLGAISFWMCSNGSLQCRICI

SEQ ID NO: 11887 - protein, 560 aa, Artificial Sequence
  hemagglutinin__InfluenzaA__AHN96323
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTIGI

SEQ ID NO: 11888 - protein, 566 aa, Artificial Sequence; identical to SEQ ID NO: 6982
  hemagglutinin__InfluenzaA__AHN96442

SEQ ID NO: 11889 - protein, 566 aa, Artificial Sequence
  hemagglutinin__InfluenzaA__AHN96443
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYTSLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11890 - protein, 566 aa, Artificial Sequence
  hemagglutinin__InfluenzaA__AHN96444
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNQQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGIELKSGYKDWILWISFAISCFLLCVALLGFIMWACQKGNIRCNICI

SEQ ID NO: 11891 - protein, 566 aa, Artificial Sequence
  hemagglutinin__InfluenzaA__AHN96445
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNQQFDKLYIWGVHHPGTDKDQIFLYAQSSGRITVSTKRSQQAVIPNIGSRPRIRNIPSRISIYWTIVKPGDILLINSTGNLIAPRGYFKILSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 11892 - protein, 566 aa, Artificial Sequence
  hemagglutinin__InfluenzaA__AHN96447
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 11893 - protein, 566 aa, Artificial Sequence
  hemagglutinin__InfluenzaA__AHV83765
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKTNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11894 - protein, 566 aa, Artificial Sequence; identical to SEQ ID NO: 11021
  hemagglutinin__InfluenzaA__AHV83766

SEQ ID NO: 11895 - protein, 566 aa, Artificial Sequence; identical to SEQ ID NO: 10040
  hemagglutinin__InfluenzaA__AHV83767

SEQ ID NO: 11896 - protein, 566 aa, Artificial Sequence
  hemagglutinin__InfluenzaA__AHV83768
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLLEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMDSVKNGTYDYPKYSEEAKLNREKIDGVKLESTRIYQILAIYSTVASSLVLVVSLGAISFWMCSNGSLQCRICI

SEQ ID NO: 11897 - protein, 566 aa, Artificial Sequence; identical to SEQ ID NO: 10998
  hemagglutinin__InfluenzaA__AHV83770

SEQ ID NO: 11898 - protein, 566 aa, Artificial Sequence
  hemagglutinin__InfluenzaA__AHV83771
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11899 - protein, 566 aa, Artificial Sequence; identical to SEQ ID NO: 10040
  hemagglutinin__InfluenzaA__AHV83772

SEQ ID NO: 11900 - protein, 566 aa, Artificial Sequence; identical to SEQ ID NO: 10040
  hemagglutinin__InfluenzaA__AHV83773

SEQ ID NO: 11901 - protein, 566 aa, Artificial Sequence; identical to SEQ ID NO: 10040
  hemagglutinin__InfluenzaA__AHV83774

SEQ ID NO: 11902 - protein, 566 aa, Artificial Sequence
  hemagglutinin__InfluenzaA__AHV83775
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11903 - protein, 566 aa, Artificial Sequence; identical to SEQ ID NO: 10040
  hemagglutinin__InfluenzaA__AHV83776

SEQ ID NO: 11904 - protein, 566 aa, Artificial Sequence
  hemagglutinin__InfluenzaA__AHV83777
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAICFWMCSNGSLQCRICI

SEQ ID NO: 11905 - protein, 566 aa, Artificial Sequence
  hemagglutinin__InfluenzaA__AHV83778
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVYDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11906 - protein, 566 aa, Artificial Sequence
  hemagglutinin__InfluenzaA__AHV83779
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11907 - protein, 566 aa, Artificial Sequence
  hemagglutinin__InfluenzaA__AHV83780
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLRQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11908 - protein, 566 aa, Artificial Sequence; identical to SEQ ID NO: 10040
  hemagglutinin__InfluenzaA__AHV83781

SEQ ID NO: 11909 - protein, 566 aa, Artificial Sequence
  hemagglutinin__InfluenzaA__AHV83782
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVAPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11910 - protein, 566 aa, Artificial Sequence
  hemagglutinin__InfluenzaA__AHV83783
MKAILVVLLYTFATANADTLCIGYHANNSTDTVDTVLEKNITVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKGFYKNLIWLVKKGNSYPKLRQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11911 - protein, 566 aa, Artificial Sequence; identical to SEQ ID NO: 10040
  hemagglutinin__InfluenzaA__AHV83784

SEQ ID NO: 11912 - protein, 566 aa, Artificial Sequence; identical to SEQ ID NO: 10040
  hemagglutinin__InfluenzaA__AHV83785

SEQ ID NO: 11913 - protein, 566 aa, Artificial Sequence; identical to SEQ ID NO: 10040
  hemagglutinin__InfluenzaA__AHV83787

SEQ ID NO: 11914 - protein, 566 aa, Artificial Sequence
  hemagglutinin__InfluenzaA__AHV83788
MKAILVVLLYTFATANADTLCIGYHANNSTDTVDTVLEKNVTVTHSVNLLEDKHNGKLCKLRGVSPLHLGKCNIAGWILGNPECESLSTASSWSYIVETSSSDNGTCYPGDFVNYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11915 - protein, 566 aa, Artificial Sequence; identical to SEQ ID NO: 11902
  hemagglutinin__InfluenzaA__AHV83789

SEQ ID NO: 11916 - protein, 566 aa, Artificial Sequence; identical to SEQ ID NO: 10040
  hemagglutinin__InfluenzaA__AHV83790

SEQ ID NO: 11917 - protein, 566 aa, Artificial Sequence; identical to SEQ ID NO: 10040
  hemagglutinin__InfluenzaA__AHV83791

SEQ ID NO: 11918 - protein, 566 aa, Artificial Sequence; identical to SEQ ID NO: 10040
  hemagglutinin__InfluenzaA__AHV83792

SEQ ID NO: 11919 - protein, 566 aa, Artificial Sequence
  hemagglutinin__InfluenzaA__AHV83793
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFEKFEIFPKTSSWPNHDSNKGVTAACPHAGAKSFYKNLIWLVKKGNSYPKLSQSYINDKGKEILVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11920 - protein, 566 aa, Artificial Sequence
  hemagglutinin__InfluenzaA__AHV83794
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11921 - protein, 566 aa, Artificial Sequence
  hemagglutinin__InfluenzaA__AHV83795
MKAILVVLLYTFATANADTLCIGYHANNSTDTVDTVLEKNVTVTHSVNLLEDKHNGKLCKLRGVAPLHLGKCNIAGWILGNPECESLSAASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADTYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTKIYQILAIYSTVASSLVLVVSLGAISFWMCSNGSLQCRICI

SEQ ID NO: 11922 - protein, 566 aa, Artificial Sequence; identical to SEQ ID NO: 11920
  hemagglutinin__InfluenzaA__AHV83796

SEQ ID NO: 11923 - protein, 566 aa, Artificial Sequence; identical to SEQ ID NO: 10040
  hemagglutinin__InfluenzaA__AHV83798

SEQ ID NO: 11924 - protein, 566 aa, Artificial Sequence; identical to SEQ ID NO: 10040
  hemagglutinin__InfluenzaA__AHV83799

SEQ ID NO: 11925 - protein, 566 aa, Artificial Sequence
  hemagglutinin__InfluenzaA__AHV83800
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENEKTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11926 - protein, 566 aa, Artificial Sequence
  hemagglutinin__InfluenzaA__AHV83801
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTKIYQILAIYSTVASSLVLVVSLGAISFWMCSNGSLQCRICI

SEQ ID NO: 11927 - protein, 566 aa, Artificial Sequence
  hemagglutinin__InfluenzaA__AHV83802
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQGLYQNVDAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11928 - protein, 566 aa, Artificial Sequence; identical to SEQ ID NO: 10040
  hemagglutinin__InfluenzaA__AHV83803

SEQ ID NO: 11929 - protein, 566 aa, Artificial Sequence; identical to SEQ ID NO: 10040
  hemagglutinin__InfluenzaA__AHV83804

SEQ ID NO: 11930 - protein, 566 aa, Artificial Sequence; identical to SEQ ID NO: 10040
  hemagglutinin__InfluenzaA__AHV83805

SEQ ID NO: 11931 - protein, 566 aa, Artificial Sequence; identical to SEQ ID NO: 11920
  hemagglutinin__InfluenzaA__AHV83806

SEQ ID NO: 11932 - protein, 566 aa, Artificial Sequence
  hemagglutinin__InfluenzaA__AHV83807
MKAILVVLLYTFATANADTLCIGYHANNSTDTVDTVLEKDVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11933 - protein, 566 aa, Artificial Sequence
  hemagglutinin__InfluenzaA__AHV83808
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNAEAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNMCMESVKNGTYDYPKYSEEAKLNREKIDGVKLESTRIYQILAIYSTVASSLVLVVSLGAISFWMCSNGSLQCRICI

SEQ ID NO: 11934 - protein, 566 aa, Artificial Sequence; identical to SEQ ID NO: 10040
  hemagglutinin__InfluenzaA__AHV83809

SEQ ID NO: 11935 - protein, 566 aa, Artificial Sequence; identical to SEQ ID NO: 11021
  hemagglutinin__InfluenzaA__AHV83810

SEQ ID NO: 11936 - protein, 566 aa, Artificial Sequence
  hemagglutinin__InfluenzaA__AHV83812
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYEYPKYSEEAKLNREKIDGVKLESTKIYQILAIYSTVASSLVLVVSLGAISFWMCSNGSLQCRICI

SEQ ID NO: 11937 - protein, 566 aa, Artificial Sequence; identical to SEQ ID NO: 10040
  hemagglutinin__InfluenzaA__AHV83813

SEQ ID NO: 11938 - protein, 566 aa, Artificial Sequence
  hemagglutinin__InfluenzaA__AHV83814
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERNLDYHDSNVKNLYEKVRNQLKTNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11939 - protein, 566 aa, Artificial Sequence; identical to SEQ ID NO: 11021
  hemagglutinin__InfluenzaA__AHV83815

SEQ ID NO: 11940 - protein, 566 aa, Artificial Sequence; identical to SEQ ID NO: 10040
  hemagglutinin__InfluenzaA__AHV83816

SEQ ID NO: 11941 - protein, 566 aa, Artificial Sequence
  hemagglutinin__InfluenzaA__AHV83817
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLVWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11942 - protein, 566 aa, Artificial Sequence; identical to SEQ ID NO: 11920
  hemagglutinin__InfluenzaA__AHV83818

SEQ ID NO: 11943 - protein, 566 aa, Artificial Sequence; identical to SEQ ID NO: 11902
  hemagglutinin__InfluenzaA__AHV83819

SEQ ID NO: 11944 - protein, 566 aa, Artificial Sequence
  hemagglutinin__InfluenzaA__AHV83821
MKAILVVLLYTFATANADTLCIGYHANNSTDTVDTVLEKNVTVTHSVNLLEDKHNGKLCKLRGVSPLHLGKCNIAGWILGNPECESLSTASSWSYIVETSSSDNGTCYPGDFVNYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHNCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11945 - protein, 566 aa, Artificial Sequence
  hemagglutinin__InfluenzaA__AHV83822
MKAILVVLLYTFATANADTLCIGYHANNSTDTVDTVLEKNVTVTHSVNLLEDKHNGKLCKLRGVSPLHLGKCNIAGWILGNPECESLSTASSWSYIVETSSSDNGTCYPGDFVNYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSIIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11946 - protein, 566 aa, Artificial Sequence
  hemagglutinin__InfluenzaA__AHV83823
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKISQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNTGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11947 - protein, 566 aa, Artificial Sequence
  hemagglutinin__InfluenzaA__AHV83824
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLRQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERNLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11948 - protein, 566 aa, Artificial Sequence; identical to SEQ ID NO: 11920
  hemagglutinin__InfluenzaA__AHV83825

SEQ ID NO: 11949 - protein, 566 aa, Artificial Sequence
  hemagglutinin__InfluenzaA__AHV83826
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYFNDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTAASSLVLVVSLGAISFWMCSNGSLQCRICI

SEQ ID NO: 11950 - protein, 566 aa, Artificial Sequence; identical to SEQ ID NO: 10040
  hemagglutinin__InfluenzaA__AHV83827

SEQ ID NO: 11951 - protein, 566 aa, Artificial Sequence; identical to SEQ ID NO: 10040
  hemagglutinin__InfluenzaA__AHV83828

SEQ ID NO: 11952 - protein, 566 aa, Artificial Sequence
  hemagglutinin__InfluenzaA__AHV83829
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKISQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11953 - protein, 566 aa, Artificial Sequence; identical to SEQ ID NO: 10040
  hemagglutinin__InfluenzaA__AHV83830

SEQ ID NO: 11954 - protein, 566 aa, Artificial Sequence
  hemagglutinin__InfluenzaA__AHV83831
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTIADQQSLYQNADAYVFVGTSRYSKKFKPEIAIRPKVRDQEGRMNYYWTLVEPGDKITFEATGNLVVPRYAFTMERNAGSGIIVSDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11955 - protein, 566 aa, Artificial Sequence; identical to SEQ ID NO: 11003
  hemagglutinin__InfluenzaA__AHV83832

SEQ ID NO: 11956 - protein, 566 aa, Artificial Sequence; identical to SEQ ID NO: 10040
  hemagglutinin__InfluenzaA__AHV83833

SEQ ID NO: 11957 - protein, 566 aa, Artificial Sequence; identical to SEQ ID NO: 11021
  hemagglutinin__InfluenzaA__AHV83834

SEQ ID NO: 11958 - protein, 566 aa, Artificial Sequence
  hemagglutinin__InfluenzaA__AHV83836
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKENSYPKLRQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11959 - protein, 566 aa, Artificial Sequence; identical to SEQ ID NO: 11907
  hemagglutinin__InfluenzaA__AHV83837

SEQ ID NO: 11960 - protein, 566 aa, Artificial Sequence; identical to SEQ ID NO: 10040
  hemagglutinin__InfluenzaA__AHV83838

SEQ ID NO: 11961 - protein, 566 aa, Artificial Sequence; identical to SEQ ID NO: 11003
  hemagglutinin__InfluenzaA__AHV83839

SEQ ID NO: 11962 - protein, 566 aa, Artificial Sequence; identical to SEQ ID NO: 11021
  hemagglutinin__InfluenzaA__AHV83840

SEQ ID NO: 11963 - protein, 566 aa, Artificial Sequence
  hemagglutinin__InfluenzaA__AHV83841
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLRQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHNCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11964 - protein, 566 aa, Artificial Sequence; identical to SEQ ID NO: 10040
  hemagglutinin__InfluenzaA__AHV83842

SEQ ID NO: 11965 - protein, 566 aa, Artificial Sequence; identical to SEQ ID NO: 10040
  hemagglutinin__InfluenzaA__AHV83843

SEQ ID NO: 11966 - protein, 566 aa, Artificial Sequence; identical to SEQ ID NO: 10040
  hemagglutinin__InfluenzaA__AHV83844

SEQ ID NO: 11967 - protein, 566 aa, Artificial Sequence
  hemagglutinin__InfluenzaA__AHV83845
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPPTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTAASSLVLVVSLGAISFWMCSNGSLQCRICI

SEQ ID NO: 11968 - protein, 566 aa, Artificial Sequence; identical to SEQ ID NO: 10040
  hemagglutinin__InfluenzaA__AHV83846

SEQ ID NO: 11969 - protein, 566 aa, Artificial Sequence; identical to SEQ ID NO: 10040
  hemagglutinin__InfluenzaA__AHV83847

SEQ ID NO: 11970 - protein, 566 aa, Artificial Sequence; identical to SEQ ID NO: 10040
  hemagglutinin__InfluenzaA__AHV83848

SEQ ID NO: 11971 - protein, 566 aa, Artificial Sequence; identical to SEQ ID NO: 11893
  hemagglutinin__InfluenzaA__AHV83849

SEQ ID NO: 11972 - protein, 566 aa, Artificial Sequence
  hemagglutinin__InfluenzaA__AHV83850
MKAILVVLLYTFATTNADTLCIGYHANNSTDTVDTVLEKNVTVTHSVNLLEDKHNGKLCKLRGVAPLHLGKCNIAGWILGNPECESLSKASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11973 - protein, 566 aa, Artificial Sequence; identical to SEQ ID NO: 10040
  hemagglutinin__InfluenzaA__AHV83851

SEQ ID NO: 11974 - protein, 566 aa, Artificial Sequence; identical to SEQ ID NO: 10040
  hemagglutinin__InfluenzaA__AHV83852

SEQ ID NO: 11975 - protein, 566 aa, Artificial Sequence
  hemagglutinin__InfluenzaA__AHV83853
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRTQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 11976 - protein, 566 aa, Artificial Sequence; identical to SEQ ID NO: 11902
  hemagglutinin__InfluenzaA__AHV83855

SEQ ID NO: 11977 - protein, 566 aa, Artificial Sequence
  hemagglutinin__InfluenzaA__AHV83856
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMEIVKNGTYDYPKYSEEAKLNREKIDGVKLESTRIYQILAIYSTVASSLVLVVSLGAISFWMCSNGSLQCRICI

SEQ ID NO: 11978 - protein, 566 aa, Artificial Sequence; identical to SEQ ID NO: 11902
  hemagglutinin__InfluenzaA__AHV83857

SEQ ID NO: 11979 - protein, 566 aa, Artificial Sequence
  hemagglutinin__InfluenzaA__AHV83858
MKAILVVLLYTFATANTDTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11980 - protein, 566 aa, Artificial Sequence; identical to SEQ ID NO: 10040
  hemagglutinin__InfluenzaA__AHV83859

SEQ ID NO: 11981 - protein, 566 aa, Artificial Sequence
  hemagglutinin__InfluenzaA__AHV83861
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11982 - protein, 566 aa, Artificial Sequence; identical to SEQ ID NO: 11981
  hemagglutinin__InfluenzaA__AHV83862

SEQ ID NO: 11983 - protein, 566 aa, Artificial Sequence; identical to SEQ ID NO: 10040
  hemagglutinin__InfluenzaA__AHV83863

SEQ ID NO: 11984 - protein, 566 aa, Artificial Sequence; identical to SEQ ID NO: 10040
  hemagglutinin__InfluenzaA__AHV83864

SEQ ID NO: 11985 - protein, 566 aa, Artificial Sequence
  hemagglutinin__InfluenzaA__AHV83866
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPIHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDDTCMESVKNGTYDYPKYSEEAKLNREKIDGVKLESTRIYQILAIYSTVASSLVLVVSLGAISFWMCSNGSLQCRICI

SEQ ID NO: 11986 - protein, 566 aa, Artificial Sequence
  hemagglutinin__InfluenzaA__AHV83867
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDDTCMESVKNGTYDYPKYSEEAKLNREKIDGVKLESTRIYQILAIYSTVASSLVLVVSLGAISFWMCSNGSLQCRICI

SEQ ID NO: 11987 - protein, 566 aa, Artificial Sequence; identical to SEQ ID NO: 10040
  hemagglutinin__InfluenzaA__AHV83868

SEQ ID NO: 11988 - protein, 566 aa, Artificial Sequence
  hemagglutinin__InfluenzaA__AHV83869
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTNSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11989 - protein, 566 aa, Artificial Sequence; identical to SEQ ID NO: 10040
  hemagglutinin__InfluenzaA__AHV83870

SEQ ID NO: 11990 - protein, 566 aa, Artificial Sequence; identical to SEQ ID NO: 10040
  hemagglutinin__InfluenzaA__AHV83871

SEQ ID NO: 11991 - protein, 566 aa, Artificial Sequence; identical to SEQ ID NO: 10040
  hemagglutinin__InfluenzaA__AHV83872

SEQ ID NO: 11992 - protein, 566 aa, Artificial Sequence
  hemagglutinin__InfluenzaA__AHV83873
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTVADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11993 - protein, 566 aa, Artificial Sequence; identical to SEQ ID NO: 10040
  hemagglutinin__InfluenzaA__AHV83874

SEQ ID NO: 11994 - protein, 566 aa, Artificial Sequence; identical to SEQ ID NO: 10040
  hemagglutinin__InfluenzaA__AHV83875

SEQ ID NO: 11995 - protein, 566 aa, Artificial Sequence; identical to SEQ ID NO: 10040
  hemagglutinin__InfluenzaA__AHV83876

SEQ ID NO: 11996 - protein, 566 aa, Artificial Sequence
  hemagglutinin__InfluenzaA__AHV83877
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFKRFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 11997 - protein, 566 aa, Artificial Sequence; identical to SEQ ID NO: 11907
  hemagglutinin__InfluenzaA__AHV83878

SEQ ID NO: 11998 - protein, 566 aa, Artificial Sequence; identical to SEQ ID NO: 11907
  hemagglutinin__InfluenzaA__AHV83879

SEQ ID NO: 11999 - protein, 566 aa, Artificial Sequence
  hemagglutinin__InfluenzaA__AHV83881
MKATLVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12000 - protein, 566 aa, Artificial Sequence; identical to SEQ ID NO: 11021
  hemagglutinin__InfluenzaA__AHV83882

SEQ ID NO: 12001 - protein, 566 aa, Artificial Sequence; identical to SEQ ID NO: 11003
  hemagglutinin__InfluenzaA__AHV83883

SEQ ID NO: 12002 - protein, 566 aa, Artificial Sequence; identical to SEQ ID NO: 10040
  hemagglutinin__InfluenzaA__AHV83884

SEQ ID NO: 12003 - protein, 566 aa, Artificial Sequence
  hemagglutinin__InfluenzaA__AHV83885
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVYDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12004 - protein, 566 aa, Artificial Sequence; identical to SEQ ID NO: 11920
  hemagglutinin__InfluenzaA__AHV83887

SEQ ID NO: 12005 - protein, 566 aa, Artificial Sequence; identical to SEQ ID NO: 10040
  hemagglutinin__InfluenzaA__AHV83888

SEQ ID NO: 12006 - protein, 566 aa, Artificial Sequence
  hemagglutinin__InfluenzaA__AHV83889
MKAILVVLLHTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12007 - protein, 566 aa, Artificial Sequence; identical to SEQ ID NO: 10040
  hemagglutinin__InfluenzaA__AHV83890

SEQ ID NO: 12008 - protein, 566 aa, Artificial Sequence; identical to SEQ ID NO: 10040
  hemagglutinin__InfluenzaA__AHV83891

SEQ ID NO: 12009 - protein, 566 aa, Artificial Sequence; identical to SEQ ID NO: 10040
  hemagglutinin__InfluenzaA__AHV83893

SEQ ID NO: 12010 - protein, 566 aa, Artificial Sequence; identical to SEQ ID NO: 10040
  hemagglutinin__InfluenzaA__AHV83894

SEQ ID NO: 12011 - protein, 566 aa, Artificial Sequence
  hemagglutinin__InfluenzaA__AHV83895
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEETKLNREKIDGVKLESTRIYQILAIYSTVASSLVLVVSLGAISFWMCSNGSLQCRICI

SEQ ID NO: 12012 - protein, 566 aa, Artificial Sequence; identical to SEQ ID NO: 10040
  hemagglutinin__InfluenzaA__AHV83896

SEQ ID NO: 12013 - protein, 566 aa, Artificial Sequence; identical to SEQ ID NO: 10040
  hemagglutinin__InfluenzaA__AHV83897

SEQ ID NO: 12014 - protein, 566 aa, Artificial Sequence
  hemagglutinin__InfluenzaA__AHV83898
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLVTGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12015 - protein, 566 aa, Artificial Sequence; identical to SEQ ID NO: 10040
  hemagglutinin__InfluenzaA__AHV83899

SEQ ID NO: 12016 - protein, 566 aa, Artificial Sequence; identical to SEQ ID NO: 10040
  hemagglutinin__InfluenzaA__AHV83900

SEQ ID NO: 12017 - protein, 566 aa, Artificial Sequence; identical to SEQ ID NO: 10040
  hemagglutinin__InfluenzaA__AHV83901

SEQ ID NO: 12018 - protein, 566 aa, Artificial Sequence; identical to SEQ ID NO: 10040
  hemagglutinin__InfluenzaA__AHV83902

SEQ ID NO: 12019 - protein, 566 aa, Artificial Sequence; identical to SEQ ID NO: 10040
  hemagglutinin__InfluenzaA__AHV83903

SEQ ID NO: 12020 - protein, 566 aa, Artificial Sequence; identical to SEQ ID NO: 10040
  hemagglutinin__InfluenzaA__AHV83904

SEQ ID NO: 12021 - protein, 566 aa, Artificial Sequence
  hemagglutinin__InfluenzaA__AHV83905
MKAILVVLLYTLTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12022 - protein, 566 aa, Artificial Sequence; identical to SEQ ID NO: 10040
  hemagglutinin__InfluenzaA__AHV83906

SEQ ID NO: 12023 - protein, 566 aa, Artificial Sequence; identical to SEQ ID NO: 10040
  hemagglutinin__InfluenzaA__AHV83907

SEQ ID NO: 12024 - protein, 566 aa, Artificial Sequence
  hemagglutinin__InfluenzaA__AHV83908
MKAILVVLLYTFATANADTLCIGYHANNSTDTVDTVLEKNVTVTHSVNLLEDKHNGKLCKLRGVAPLHLGKCNIAGWILGNPECEPLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKKVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12025 - protein, 566 aa, Artificial Sequence
  hemagglutinin__InfluenzaA__AHV83911
MKAILVVLLYTFATANADTLCIGYHANNSTDTVDTVLEKNVTVTHSVNLLEDKHNGKLCKLRGVAPLHLGKCNIAGWILGNPECEPLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12026 - protein, 566 aa, Artificial Sequence; identical to SEQ ID NO: 10040
  hemagglutinin__InfluenzaA__AHV83912

SEQ ID NO: 12027 - protein, 566 aa, Artificial Sequence; identical to SEQ ID NO: 10040
  hemagglutinin__InfluenzaA__AHV83913

SEQ ID NO: 12028 - protein, 566 aa, Artificial Sequence; identical to SEQ ID NO: 10040
  hemagglutinin__InfluenzaA__AHV83915

SEQ ID NO: 12029 - protein, 566 aa, Artificial Sequence; identical to SEQ ID NO: 10040
  hemagglutinin__InfluenzaA__AHV83916

SEQ ID NO: 12030 - protein, 566 aa, Artificial Sequence; identical to SEQ ID NO: 12025
  hemagglutinin__InfluenzaA__AHV83917

SEQ ID NO: 12031 - protein, 566 aa, Artificial Sequence; identical to SEQ ID NO: 11003
  hemagglutinin__InfluenzaA__AHV83919

SEQ ID NO: 12032 - protein, 566 aa, Artificial Sequence; identical to SEQ ID NO: 11920
  hemagglutinin__InfluenzaA__AHV83920

SEQ ID NO: 12033 - protein, 566 aa, Artificial Sequence; identical to SEQ ID NO: 11021
  hemagglutinin__InfluenzaA__AHV83921

SEQ ID NO: 12034 - protein, 566 aa, Artificial Sequence
  hemagglutinin__InfluenzaA__AHV83922
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFSHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12035 - protein, 566 aa, Artificial Sequence; identical to SEQ ID NO: 11936
  hemagglutinin__InfluenzaA__AHV83923

SEQ ID NO: 12036 - protein, 566 aa, Artificial Sequence; identical to SEQ ID NO: 11920
  hemagglutinin__InfluenzaA__AHV83924

SEQ ID NO: 12037 - protein, 566 aa, Artificial Sequence; identical to SEQ ID NO: 11936
  hemagglutinin__InfluenzaA__AHV83925

SEQ ID NO: 12038 - protein, 566 aa, Artificial Sequence; identical to SEQ ID NO: 11920
  hemagglutinin__InfluenzaA__AHV83926

SEQ ID NO: 12039 - protein, 566 aa, Artificial Sequence; identical to SEQ ID NO: 12025
  hemagglutinin__InfluenzaA__AHV83927

SEQ ID NO: 12040 - protein, 566 aa, Artificial Sequence
  hemagglutinin__InfluenzaA__AHV83928
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12041 - protein, 566 aa, Artificial Sequence; identical to SEQ ID NO: 11920
  hemagglutinin__InfluenzaA__AHV83929

SEQ ID NO: 12042 - protein, 566 aa, Artificial Sequence
  hemagglutinin__InfluenzaA__AHV83930
MKAILVILLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12043 - protein, 566 aa, Artificial Sequence; identical to SEQ ID NO: 11920
  hemagglutinin__InfluenzaA__AHV83931

SEQ ID NO: 12044 - protein, 566 aa, Artificial Sequence; identical to SEQ ID NO: 10040
  hemagglutinin__InfluenzaA__AHV83932

SEQ ID NO: 12045 - protein, 566 aa, Artificial Sequence
  hemagglutinin__InfluenzaA__AHV83933
MKAILVVLLYTFATANADTLCIGYHANNSTDTVDTVLEKNVTVTHSVNLLEDKHNGKLCKLRGVTPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILALYSTVASSLVLVVSLGAISFWMCSNGSLQCRICI

SEQ ID NO: 12046 - protein, 566 aa, Artificial Sequence; identical to SEQ ID NO: 11003
  hemagglutinin__InfluenzaA__AHV83934

SEQ ID NO: 12047 - protein, 566 aa, Artificial Sequence; identical to SEQ ID NO: 10040
  hemagglutinin__InfluenzaA__AHV83935

SEQ ID NO: 12048 - protein, 566 aa, Artificial Sequence; identical to SEQ ID NO: 10040
  hemagglutinin__InfluenzaA__AHV83937

SEQ ID NO: 12049 - protein, 566 aa, Artificial Sequence
  hemagglutinin__InfluenzaA__AHV83938
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKISQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12050 - protein, 566 aa, Artificial Sequence; identical to SEQ ID NO: 12049
  hemagglutinin__InfluenzaA__AHV83939

SEQ ID NO: 12051 - protein, 566 aa, Artificial Sequence
  hemagglutinin__InfluenzaA__AHV83940
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFMDIWTYNAELLVLLENERTLDYHDSNVKNLYEKVRNQLKNNAKEIGNGCFEFYHKCDNTCMESVKNGTYDYPKYSEEAKLNREKIDRVKLESTRIYQILAIYSTVASSLVLVVSLGAISFWMCSNGSLQCRICI

SEQ ID NO: 12052 - protein, 566 aa, Artificial Sequence; identical to SEQ ID NO: 10040
  hemagglutinin__InfluenzaA__AHV83941

SEQ ID NO: 12053 - protein, 566 aa, Artificial Sequence
  hemagglutinin__InfluenzaA__AHV83943
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNMCMESVKNGTYDYPKYSEEAKLNREKIDGVKLESTRIYQILAIYSTVASSLVLVVSLGAISFWMCSNGSLQCRICI

SEQ ID NO: 12054 - protein, 566 aa, Artificial Sequence
  hemagglutinin__InfluenzaA__AHV83944
MKAILVVLLYTFATANADTLCIGYHANNSTDTVDTVLEKNVTVTHSVNLLEDEHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12055 - protein, 566 aa, Artificial Sequence
  hemagglutinin__InfluenzaA__AHV83945
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12056 - protein, 566 aa, Artificial Sequence
  hemagglutinin__InfluenzaA__AHV83947
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTVKRNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12057 - protein, 566 aa, Artificial Sequence; identical to SEQ ID NO: 10040
  hemagglutinin__InfluenzaA__AHV83948

SEQ ID NO: 12058 - protein, 566 aa, Artificial Sequence; identical to SEQ ID NO: 10040
  hemagglutinin__InfluenzaA__AHV83949

SEQ ID NO: 12059 - protein, 566 aa, Artificial Sequence; identical to SEQ ID NO: 10040
  hemagglutinin__InfluenzaA__AHV83950

SEQ ID NO: 12060 - protein, 566 aa, Artificial Sequence
  hemagglutinin__InfluenzaA__AHV83953
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDLGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12061 - protein, 566 aa, Artificial Sequence; identical to SEQ ID NO: 11892
  hemagglutinin__InfluenzaA__AHV83954

SEQ ID NO: 12062 - protein, 566 aa, Artificial Sequence
  hemagglutinin__InfluenzaA__AHV83956
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNENFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVQEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12063 - protein, 566 aa, Artificial Sequence
  hemagglutinin__InfluenzaA__AHZ13523
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYKSESKYPVLNVTMPNNGKFDKLYIWGVHHPSTDKEQTNLYVRASGRVTVSTKRSQQTVIPNIGSRPWVRGLSSRISIYWTIVKPGDILLINSTGNLIAPRGYFKIRTGKSSIMRSDAPIGTCSYECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 12064 - protein, 565 aa, Artificial Sequence; identical to SEQ ID NO: 3616
  hemagglutinin__InfluenzaA__AHZ13582

SEQ ID NO: 12065 - protein, 566 aa, Artificial Sequence
  hemagglutinin__InfluenzaA__AHZ35584
MKTIIALSYILCLIFAQEIPGNDNSTATLCLGHHAVPNGTIVKTITNDQIEVTNATELVQSSSTGEICNSPHQILDGENCTLIDALLGDPQCDDFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12066 - protein, 566 aa, Artificial Sequence
  hemagglutinin__InfluenzaA__AHZ35608
MKTIIALSYILCLIFAQEIPGNDNSTATLCLGHHAVPNGTIVKTITNDQIEVTNATELVQSSSTGEICNSPHQILDGENCTLIDALLGDPQCDDFQNKEWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGTCPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12067 - protein, 566 aa, Artificial Sequence; identical to SEQ ID NO: 12065
  hemagglutinin__InfluenzaA__AHZ35620

SEQ ID NO: 12068 - protein, 566 aa, Artificial Sequence; identical to SEQ ID NO: 12065
  hemagglutinin__InfluenzaA__AHZ35632

SEQ ID NO: 12069 - protein, 566 aa, Artificial Sequence; identical to SEQ ID NO: 12065
  hemagglutinin__InfluenzaA__AHZ35644

SEQ ID NO: 12070 - protein, 566 aa, Artificial Sequence; identical to SEQ ID NO: 12065
  hemagglutinin__InfluenzaA__AHZ35656

SEQ ID NO: 12071 - protein, 566 aa, Artificial Sequence; identical to SEQ ID NO: 12065
  hemagglutinin__InfluenzaA__AHZ35668

SEQ ID NO: 12072 - protein, 566 aa, Artificial Sequence; identical to SEQ ID NO: 12066
  hemagglutinin__InfluenzaA__AHZ35680

SEQ ID NO: 12073 - protein, 566 aa, Artificial Sequence; identical to SEQ ID NO: 12065
  hemagglutinin__InfluenzaA__AHZ35692

SEQ ID NO: 12074 - protein, 566 aa, Artificial Sequence; identical to SEQ ID NO: 12065
  hemagglutinin__InfluenzaA__AHZ35716

SEQ ID NO: 12075 - protein, 566 aa, Artificial Sequence; identical to SEQ ID NO: 12066
  hemagglutinin__InfluenzaA__AHZ35728

SEQ ID NO: 12076 - protein, 566 aa, Artificial Sequence; identical to SEQ ID NO: 12065
  hemagglutinin__InfluenzaA__AHZ35740

SEQ ID NO: 12077 - protein, 566 aa, Artificial Sequence; identical to SEQ ID NO: 12065
  hemagglutinin__InfluenzaA__AHZ35752

SEQ ID NO: 12078 - protein, 566 aa, Artificial Sequence; identical to SEQ ID NO: 12065
  hemagglutinin__InfluenzaA__AHZ35764

SEQ ID NO: 12079 - protein, 566 aa, Artificial Sequence; identical to SEQ ID NO: 12065
  hemagglutinin__InfluenzaA__AHZ35776

SEQ ID NO: 12080 - protein, 566 aa, Artificial Sequence
  hemagglutinin__InfluenzaA__AHZ35823
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12081 - protein, 566 aa, Artificial Sequence; identical to SEQ ID NO: 12080
  hemagglutinin__InfluenzaA__AHZ35834

SEQ ID NO: 12082 - protein, 566 aa, Artificial Sequence; identical to SEQ ID NO: 12080
  hemagglutinin__InfluenzaA__AHZ35845

SEQ ID NO: 12083 - protein, 566 aa, Artificial Sequence; identical to SEQ ID NO: 12080
  hemagglutinin__InfluenzaA__AHZ35856

SEQ ID NO: 12084 - protein, 566 aa, Artificial Sequence
  hemagglutinin__InfluenzaA__AHZ35867
MKTNIALSYILCLVSAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVVLENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12085 - protein, 566 aa, Artificial Sequence
  hemagglutinin__InfluenzaA__AHZ35879
MKTNIALSYILCLVSAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12086 - protein, 566 aa, Artificial Sequence; identical to SEQ ID NO: 12080
  hemagglutinin__InfluenzaA__AHZ35891

SEQ ID NO: 12087 - protein, 566 aa, Artificial Sequence; identical to SEQ ID NO: 12080
  hemagglutinin__InfluenzaA__AHZ35902

SEQ ID NO: 12088 - protein, 569 aa, Artificial Sequence
  hemagglutinin__InfluenzaA__AHZ35913
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYERVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12089 - protein, 566 aa, Artificial Sequence
  hemagglutinin__InfluenzaA__AHZ35924
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPQAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSTQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12090 - protein, 566 aa, Artificial Sequence
  hemagglutinin__InfluenzaA__AHZ35935
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12091 - protein, 566 aa, Artificial Sequence; identical to SEQ ID NO: 12085
  hemagglutinin__InfluenzaA__AHZ35946

SEQ ID NO: 12092 - protein, 566 aa, Artificial Sequence; identical to SEQ ID NO: 12080
  hemagglutinin__InfluenzaA__AHZ35958

SEQ ID NO: 12093 - protein, 566 aa, Artificial Sequence; identical to SEQ ID NO: 12080
  hemagglutinin__InfluenzaA__AHZ35980

SEQ ID NO: 12094 - protein, 566 aa, Artificial Sequence; identical to SEQ ID NO: 12080
  hemagglutinin__InfluenzaA__AHZ35991

SEQ ID NO: 12095 - protein, 566 aa, Artificial Sequence; identical to SEQ ID NO: 12080
  hemagglutinin__InfluenzaA__AHZ36002

SEQ ID NO: 12096 - protein, 566 aa, Artificial Sequence
  hemagglutinin__InfluenzaA__AHZ36013
MKAILVVLLYTFAIANADTLCIGYHANNSTDTVDTVLEKNVTVTHSVNLLEDKHNRKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12097 - protein, 566 aa, Artificial Sequence
  hemagglutinin__InfluenzaA__AHZ36024
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRTYQILAIYSTVASSLVLVVSLGAISFWMCSNGSLQCRICI

SEQ ID NO: 12098 - protein, 566 aa, Artificial Sequence
  hemagglutinin__InfluenzaA__AHZ36035
MKTIIALSYILCLVFAQKLPGNDNSTATLCLGHHAVPNGTIVKTITNDQIEVTNATELIQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12099 - protein, 566 aa, Artificial Sequence; identical to SEQ ID NO: 6855
  hemagglutinin__InfluenzaA__AHZ36047

SEQ ID NO: 12100 - protein, 566 aa, Artificial Sequence; identical to SEQ ID NO: 12080
  hemagglutinin__InfluenzaA__AHZ36059

SEQ ID NO: 12101 - protein, 566 aa, Artificial Sequence; identical to SEQ ID NO: 12097
  hemagglutinin__InfluenzaA__AHZ36070

SEQ ID NO: 12102 - protein, 566 aa, Artificial Sequence; identical to SEQ ID NO: 12096
  hemagglutinin__InfluenzaA__AHZ36081

SEQ ID NO: 12103 - protein, 566 aa, Artificial Sequence; identical to SEQ ID NO: 12097
  hemagglutinin__InfluenzaA__AHZ36092

SEQ ID NO: 12104 - protein, 566 aa, Artificial Sequence; identical to SEQ ID NO: 12080
  hemagglutinin__InfluenzaA__AHZ36103

SEQ ID NO: 12105 - protein, 566 aa, Artificial Sequence; identical to SEQ ID NO: 12097
  hemagglutinin__InfluenzaA__AHZ36114

SEQ ID NO: 12106 - protein, 566 aa, Artificial Sequence; identical to SEQ ID NO: 12080
  hemagglutinin__InfluenzaA__AHZ36125

SEQ ID NO: 12107 - protein, 566 aa, Artificial Sequence; identical to SEQ ID NO: 12080
  hemagglutinin__InfluenzaA__AHZ36136

SEQ ID NO: 12108 - protein, 566 aa, Artificial Sequence; identical to SEQ ID NO: 6855
  hemagglutinin__InfluenzaA__AHZ36147

SEQ ID NO: 12109 - protein, 566 aa, Artificial Sequence
  hemagglutinin__InfluenzaA__AHZ36158
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIATRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12110 - protein, 566 aa, Artificial Sequence; identical to SEQ ID NO: 12080
  hemagglutinin__InfluenzaA__AHZ36169

SEQ ID NO: 12111 - protein, 566 aa, Artificial Sequence
  hemagglutinin__InfluenzaA__AHZ36180
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12112 - protein, 566 aa, Artificial Sequence; identical to SEQ ID NO: 12085
  hemagglutinin__InfluenzaA__AHZ36191

SEQ ID NO: 12113 - protein, 566 aa, Artificial Sequence; identical to SEQ ID NO: 6855
  hemagglutinin__InfluenzaA__AHZ36203

SEQ ID NO: 12114 - protein, 566 aa, Artificial Sequence; identical to SEQ ID NO: 12080
  hemagglutinin__InfluenzaA__AHZ36215

SEQ ID NO: 12115 - protein, 566 aa, Artificial Sequence; identical to SEQ ID NO: 6855
  hemagglutinin__InfluenzaA__AHZ36226

SEQ ID NO: 12116 - protein, 566 aa, Artificial Sequence; identical to SEQ ID NO: 12080
  hemagglutinin__InfluenzaA__AHZ36238

SEQ ID NO: 12117 - protein, 566 aa, Artificial Sequence; identical to SEQ ID NO: 12080
  hemagglutinin__InfluenzaA__AHZ36249

SEQ ID NO: 12118 - protein, 566 aa, Artificial Sequence
  hemagglutinin__InfluenzaA__AHZ36260
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETFSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12119 - protein, 566 aa, Artificial Sequence; identical to SEQ ID NO: 12065
  hemagglutinin__InfluenzaA__AHZ36271

SEQ ID NO: 12120 - protein, 566 aa, Artificial Sequence; identical to SEQ ID NO: 12080
  hemagglutinin__InfluenzaA__AHZ36283

SEQ ID NO: 12121 - protein, 566 aa, Artificial Sequence; identical to SEQ ID NO: 12065
  hemagglutinin__InfluenzaA__AHZ36294

SEQ ID NO: 12122 - protein, 566 aa, Artificial Sequence
  hemagglutinin__InfluenzaA__AHZ36306
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSKKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12123 - protein, 566 aa, Artificial Sequence; identical to SEQ ID NO: 12080
  hemagglutinin__InfluenzaA__AHZ36317

SEQ ID NO: 12124 - protein, 566 aa, Artificial Sequence; identical to SEQ ID NO: 12080
  hemagglutinin__InfluenzaA__AHZ36328

SEQ ID NO: 12125 - protein, 566 aa, Artificial Sequence
  hemagglutinin__InfluenzaA__AHZ36339
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAVNTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLERRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12126 - protein, 566 aa, Artificial Sequence
  hemagglutinin__InfluenzaA__AHZ36362
MKAILVVLLYTFAIANADTLCIGYHANNSTDTVDTVLEKNVTVTHSINLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAVNTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLERRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12127 - protein, 566 aa, Artificial Sequence
  hemagglutinin__InfluenzaA__AHZ36385
MKTIIALSYILCLIFAQEIPGNDNSTATLCLGHHAVPNGTIVKTITNDQIEVTNATELVQSSSTGEICNSPHQILDGENCTLIDALLGDPQCDDFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFKIKGVELKSGYKDWILWISFAISCFLLCVALLGFIMWACQKGNIRCNICI

SEQ ID NO: 12128 - protein, 566 aa, Artificial Sequence
  hemagglutinin__InfluenzaA__AHZ36397
MKTIIALSYILCLIFAQEIPGNDNSTATLCLGHHAVPNGTIVKTITNDQIEVTNATELVQSSSTGEICNSPHQILDGENCTLIDALLGDPQCDDFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFKIKGVELKSGYKDWILWISFAISCFLLCVALLGFIMWACQKGNIRCNICI

SEQ ID NO: 12129 - protein, 566 aa, Artificial Sequence; identical to SEQ ID NO: 12065
  hemagglutinin__InfluenzaA__AHZ36409

SEQ ID NO: 12130 - protein, 566 aa, Artificial Sequence; identical to SEQ ID NO: 12066
  hemagglutinin__InfluenzaA__AHZ36433

SEQ ID NO: 12131 - protein, 566 aa, Artificial Sequence
  hemagglutinin__InfluenzaA__AHZ36445
MKTIIALSYILCLIFAQEIPGNDNSTATLCLGHHAVPNGTIVKTITNDQIEVTNATELVQSSSTGEICNSPHQILDGENCTLIDALLGDPQCDDFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDDACIGSIRNGTYDHDVYRDEALNNRFQIKGVELKSGYKDWILWISFAISCFLLCVALLGFIMWACQKGNIRCNICI

SEQ ID NO: 12132 - protein, 566 aa, Artificial Sequence; identical to SEQ ID NO: 12065
  hemagglutinin__InfluenzaA__AHZ36457

SEQ ID NO: 12133 - protein, 566 aa, Artificial Sequence; identical to SEQ ID NO: 12065
  hemagglutinin__InfluenzaA__AHZ36469

SEQ ID NO: 12134 - protein, 566 aa, Artificial Sequence
  hemagglutinin__InfluenzaA__AHZ36481
MKTIIALSYILCLIFAQEIPGNDNSTATLCLGHHAVPNGTIVKTITNDQIEVTNATELVQSSSTGEICNSPHQILDGENCTLIDALLGDPQCDDFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRNGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12135 - protein, 566 aa, Artificial Sequence; identical to SEQ ID NO: 12066
  hemagglutinin__InfluenzaA__AHZ36493

SEQ ID NO: 12136 - protein, 566 aa, Artificial Sequence; identical to SEQ ID NO: 12066
  hemagglutinin__InfluenzaA__AHZ36505

SEQ ID NO: 12137 - protein, 566 aa, Artificial Sequence; identical to SEQ ID NO: 12066
  hemagglutinin__InfluenzaA__AHZ36517

SEQ ID NO: 12138 - protein, 566 aa, Artificial Sequence
  hemagglutinin__InfluenzaA__AHZ36529
MKTIIALSYILCLIFAQEIPGNDNSTATLCLGHHAVPNGTIVKTITNDQIEVTNATELVQSSSTGEICNSPHQILDGENCTLIDALLGDPQCDDFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSSCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12139 - protein, 566 aa, Artificial Sequence; identical to SEQ ID NO: 12065
  hemagglutinin__InfluenzaA__AHZ36541

SEQ ID NO: 12140 - protein, 566 aa, Artificial Sequence
  hemagglutinin__InfluenzaA__AHZ36553
MKTIIALSYILCLIFAQEIPGNDNSTATLCLGHHAVPNGTIVKTITNDQIEVTNATELVQSSSTGEICNSPHQILDGENCTLIDALLGDPQCDDFQNKEWDLFVERSKAHSNCYPYDVPDYASLRSLVASSGTLEFKNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGTCPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12141 - protein, 566 aa, Artificial Sequence; identical to SEQ ID NO: 12065
  hemagglutinin__InfluenzaA__AHZ36565

SEQ ID NO: 12142 - protein, 566 aa, Artificial Sequence; identical to SEQ ID NO: 12065
  hemagglutinin__InfluenzaA__AHZ36577

SEQ ID NO: 12143 - protein, 566 aa, Artificial Sequence; identical to SEQ ID NO: 12065
  hemagglutinin__InfluenzaA__AHZ36589

SEQ ID NO: 12144 - protein, 566 aa, Artificial Sequence; identical to SEQ ID NO: 12140
  hemagglutinin__InfluenzaA__AHZ36601

SEQ ID NO: 12145 - protein, 566 aa, Artificial Sequence
  hemagglutinin__InfluenzaA__AHZ36613
MKTIIALSYILCLIFAQEIPGNDNSTATLCLGHHAVPNGTIVKTITNDQIEVTNATELVQSSSTGEICNSPHQILDGENCTLIDALLGDPQCDDFQNKEWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGTCPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFATSCFLLCVALLGFIMWACQKGNIRCNICI

SEQ ID NO: 12146 - protein, 566 aa, Artificial Sequence; identical to SEQ ID NO: 12065
  hemagglutinin__InfluenzaA__AHZ36625

SEQ ID NO: 12147 - protein, 566 aa, Artificial Sequence; identical to SEQ ID NO: 12066
  hemagglutinin__InfluenzaA__AHZ36637

SEQ ID NO: 12148 - protein, 566 aa, Artificial Sequence; identical to SEQ ID NO: 12066
  hemagglutinin__InfluenzaA__AHZ36649

SEQ ID NO: 12149 - protein, 566 aa, Artificial Sequence; identical to SEQ ID NO: 9994
  hemagglutinin__InfluenzaA__AHZ36661

SEQ ID NO: 12150 - protein, 566 aa, Artificial Sequence; identical to SEQ ID NO: 9994
  hemagglutinin__InfluenzaA__AHZ36673

SEQ ID NO: 12151 - protein, 566 aa, Artificial Sequence
  hemagglutinin__InfluenzaA__AHZ36685
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKRVELKSGYKDWILWISFAISCFLLCVALLGFIMWACQKGNIRCNICI

SEQ ID NO: 12152 - protein, 560 aa, Artificial Sequence; identical to SEQ ID NO: 9988
  hemagglutinin__InfluenzaA__AHZ39698

SEQ ID NO: 12153 - protein, 560 aa, Artificial Sequence
  hemagglutinin__InfluenzaA__AHZ39722
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTDGATSACRRSGSSFYAEMKWLLSNTDDAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 12154 - protein, 560 aa, Artificial Sequence; identical to SEQ ID NO: 12153
  hemagglutinin__InfluenzaA__AHZ39734

SEQ ID NO: 12155 - protein, 560 aa, Artificial Sequence
  hemagglutinin__InfluenzaA__AHZ39746
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGERPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 12156 - protein, 560 aa, Artificial Sequence; identical to SEQ ID NO: 12153
  hemagglutinin__InfluenzaA__AHZ39758

SEQ ID NO: 12157 - protein, 560 aa, Artificial Sequence; identical to SEQ ID NO: 12153
  hemagglutinin__InfluenzaA__AHZ39770

SEQ ID NO: 12158 - protein, 560 aa, Artificial Sequence; identical to SEQ ID NO: 12153
  hemagglutinin__InfluenzaA__AHZ39782

SEQ ID NO: 12159 - protein, 566 aa, Artificial Sequence; identical to SEQ ID NO: 9883
  hemagglutinin__InfluenzaA__AHZ39794

SEQ ID NO: 12160 - protein, 566 aa, Artificial Sequence; identical to SEQ ID NO: 9997
  hemagglutinin__InfluenzaA__AHZ39806

SEQ ID NO: 12161 - protein, 566 aa, Artificial Sequence
  hemagglutinin__InfluenzaA__AHZ39818
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQTFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELIVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12162 - protein, 566 aa, Artificial Sequence; identical to SEQ ID NO: 9883
  hemagglutinin__InfluenzaA__AHZ39841

SEQ ID NO: 12163 - protein, 566 aa, Artificial Sequence; identical to SEQ ID NO: 9903
  hemagglutinin__InfluenzaA__AHZ39853

SEQ ID NO: 12164 - protein, 566 aa, Artificial Sequence; identical to SEQ ID NO: 9883
  hemagglutinin__InfluenzaA__AHZ39865

SEQ ID NO: 12165 - protein, 566 aa, Artificial Sequence
  hemagglutinin__InfluenzaA__AHZ39877
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFATSCFLLCVALLGFIMWACQKGNIRCNICI

SEQ ID NO: 12166 - protein, 566 aa, Artificial Sequence; identical to SEQ ID NO: 9903
  hemagglutinin__InfluenzaA__AHZ39889

SEQ ID NO: 12167 - protein, 566 aa, Artificial Sequence; identical to SEQ ID NO: 9884
  hemagglutinin__InfluenzaA__AHZ39913

SEQ ID NO: 12168 - protein, 566 aa, Artificial Sequence
  hemagglutinin__InfluenzaA__AHZ39925
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12169 - protein, 566 aa, Artificial Sequence; identical to SEQ ID NO: 9883
  hemagglutinin__InfluenzaA__AHZ39937

SEQ ID NO: 12170 - protein, 566 aa, Artificial Sequence; identical to SEQ ID NO: 9883
  hemagglutinin__InfluenzaA__AHZ39949

SEQ ID NO: 12171 - protein, 566 aa, Artificial Sequence; identical to SEQ ID NO: 9883
  hemagglutinin__InfluenzaA__AHZ39961

SEQ ID NO: 12172 - protein, 566 aa, Artificial Sequence; identical to SEQ ID NO: 9883
  hemagglutinin__InfluenzaA__AHZ39973

SEQ ID NO: 12173 - protein, 566 aa, Artificial Sequence
  hemagglutinin__InfluenzaA__AHZ39985
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDASIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFATSCFLLCVALLGFIMWACQKGNIRCNICI

SEQ ID NO: 12174 - protein, 566 aa, Artificial Sequence; identical to SEQ ID NO: 9883
  hemagglutinin__InfluenzaA__AHZ39997

SEQ ID NO: 12175 - protein, 566 aa, Artificial Sequence
  hemagglutinin__InfluenzaA__AHZ40009
MKTIIALSYILCLVFAQKLPGNDNSTATLCLGHHAVPNGTIVKTITNDRIEVTNATELVQISSIGEICDSPHQILDGENCTLIDALLGDPQCDGFQNKKWDLFVERSKAYSNCYPYDVPDYASLRSLVASSGTLEFNNESFNWTGVTQNGTSSACIRKSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12176 - protein, 566 aa, Artificial Sequence; identical to SEQ ID NO: 9883
  hemagglutinin__InfluenzaA__AHZ40021

SEQ ID NO: 12177 - protein, 566 aa, Artificial Sequence; identical to SEQ ID NO: 9858
  hemagglutinin__InfluenzaA__AHZ40033

SEQ ID NO: 12178 - protein, 566 aa, Artificial Sequence; identical to SEQ ID NO: 9883
  hemagglutinin__InfluenzaA__AHZ40045

SEQ ID NO: 12179 - protein, 566 aa, Artificial Sequence; identical to SEQ ID NO: 9883
  hemagglutinin__InfluenzaA__AHZ40060

SEQ ID NO: 12180 - protein, 566 aa, Artificial Sequence; identical to SEQ ID NO: 9883
  hemagglutinin__InfluenzaA__AHZ40072

SEQ ID NO: 12181 - protein, 566 aa, Artificial Sequence; identical to SEQ ID NO: 9883
  hemagglutinin__InfluenzaA__AHZ40084

SEQ ID NO: 12182 - protein, 566 aa, Artificial Sequence; identical to SEQ ID NO: 9883
  hemagglutinin__InfluenzaA__AHZ40096

SEQ ID NO: 12183 - protein, 566 aa, Artificial Sequence; identical to SEQ ID NO: 9884
  hemagglutinin__InfluenzaA__AHZ40108

SEQ ID NO: 12184 - protein, 566 aa, Artificial Sequence; identical to SEQ ID NO: 9997
  hemagglutinin__InfluenzaA__AHZ40120

SEQ ID NO: 12185 - protein, 566 aa, Artificial Sequence
  hemagglutinin__InfluenzaA__AHZ40130
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKNWILWISFAISCFLLCVALLGFIMWACQKGNIRCNICI

SEQ ID NO: 12186 - protein, 566 aa, Artificial Sequence
  hemagglutinin__InfluenzaA__AHZ40142
MKTIIALSYILCLVFAQKLPGNDNSTATLCLGHHAVPNGTIVKTITNDRIEVTNATELVQNSSIGEICDSPHQILDGENCTLIDALLGDPQCDGFQDKKWDLFVERSKAYSNCYPYDVPDYASLRSLVASSGTLEFNNENFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDRPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12187 - protein, 566 aa, Artificial Sequence
  hemagglutinin__InfluenzaA__AHZ40154
MKTIIALSYILCLGFAQELPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRGSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDMLLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCNNACIGSIRNGTYDHDVYRDEALNNRFQIKGVELKSGYKDWILWISFAISCFLLCVALLGFIMWACQKGNIRCNICI

SEQ ID NO: 12188 - protein, 566 aa, Artificial Sequence
  hemagglutinin__InfluenzaA__AHZ40166
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGRCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12189 - protein, 566 aa, Artificial Sequence; identical to SEQ ID NO: 9883
  hemagglutinin__InfluenzaA__AHZ40177

SEQ ID NO: 12190 - protein, 566 aa, Artificial Sequence; identical to SEQ ID NO: 9883
  hemagglutinin__InfluenzaA__AHZ40189

SEQ ID NO: 12191 - protein, 566 aa, Artificial Sequence; identical to SEQ ID NO: 9883
  hemagglutinin__InfluenzaA__AHZ40201

SEQ ID NO: 12192 - protein, 566 aa, Artificial Sequence; identical to SEQ ID NO: 9868
  hemagglutinin__InfluenzaA__AHZ40213

SEQ ID NO: 12193 - protein, 566 aa, Artificial Sequence; identical to SEQ ID NO: 9835
  hemagglutinin__InfluenzaA__AHZ40225

SEQ ID NO: 12194 - protein, 566 aa, Artificial Sequence
  hemagglutinin__InfluenzaA__AHZ40237
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPTDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12195 - protein, 566 aa, Artificial Sequence; identical to SEQ ID NO: 9891
  hemagglutinin__InfluenzaA__AHZ40249

SEQ ID NO: 12196 - protein, 566 aa, Artificial Sequence; identical to SEQ ID NO: 9858
  hemagglutinin__InfluenzaA__AHZ40261

SEQ ID NO: 12197 - protein, 566 aa, Artificial Sequence; identical to SEQ ID NO: 9997
  hemagglutinin__InfluenzaA__AHZ40273

SEQ ID NO: 12198 - protein, 566 aa, Artificial Sequence
  hemagglutinin__InfluenzaA__AHZ40285
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSDSSFFSRLNWLTHLNFKYPALNVTMPNNEQFDKLYIWGVHHPGTDKDQIFLYAQASGRITVSTKRSQQSVIPNIGSRPRIRNIPSRISIYWTIVKPGDILLINSTGNLIAPRGYFKIQSGKSSIMRSDTPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 12199 - protein, 566 aa, Artificial Sequence; identical to SEQ ID NO: 9994
  hemagglutinin__InfluenzaA__AHZ40297

SEQ ID NO: 12200 - protein, 566 aa, Artificial Sequence
  hemagglutinin__InfluenzaA__AHZ40309
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRNGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12201 - protein, 566 aa, Artificial Sequence; identical to SEQ ID NO: 9883
  hemagglutinin__InfluenzaA__AHZ40321

SEQ ID NO: 12202 - protein, 566 aa, Artificial Sequence; identical to SEQ ID NO: 9883
  hemagglutinin__InfluenzaA__AHZ40333

SEQ ID NO: 12203 - protein, 566 aa, Artificial Sequence
  hemagglutinin__InfluenzaA__AHZ40345
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPSDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12204 - protein, 566 aa, Artificial Sequence; identical to SEQ ID NO: 9884
  hemagglutinin__InfluenzaA__AHZ40357

SEQ ID NO: 12205 - protein, 566 aa, Artificial Sequence
  hemagglutinin__InfluenzaA__AHZ40369
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGRSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12206 - protein, 566 aa, Artificial Sequence; identical to SEQ ID NO: 9994
  hemagglutinin__InfluenzaA__AHZ40381

SEQ ID NO: 12207 - protein, 566 aa, Artificial Sequence; identical to SEQ ID NO: 9883
  hemagglutinin__InfluenzaA__AHZ40393

SEQ ID NO: 12208 - protein, 566 aa, Artificial Sequence; identical to SEQ ID NO: 9883
  hemagglutinin__InfluenzaA__AHZ40405

SEQ ID NO: 12209 - protein, 566 aa, Artificial Sequence; identical to SEQ ID NO: 9883
  hemagglutinin__InfluenzaA__AHZ40417

SEQ ID NO: 12210 - protein, 566 aa, Artificial Sequence
  hemagglutinin__InfluenzaA__AHZ40429
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFKNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12211 - protein, 566 aa, Artificial Sequence; identical to SEQ ID NO: 9883
  hemagglutinin__InfluenzaA__AHZ40441

SEQ ID NO: 12212 - protein, 566 aa, Artificial Sequence; identical to SEQ ID NO: 10026
  hemagglutinin__InfluenzaA__AHZ40453

SEQ ID NO: 12213 - protein, 566 aa, Artificial Sequence
  hemagglutinin__InfluenzaA__AHZ40465
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDMPDYASLRSLVASSGTLEFNNESFNWTGVTQNGTSSACIRRSNSSFFSRLNWLTHLNFKYPALNVTMPNNERFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12214 - protein, 566 aa, Artificial Sequence; identical to SEQ ID NO: 9884
  hemagglutinin__InfluenzaA__AHZ40477

SEQ ID NO: 12215 - protein, 566 aa, Artificial Sequence; identical to SEQ ID NO: 10060
  hemagglutinin__InfluenzaA__AHZ40489

SEQ ID NO: 12216 - protein, 566 aa, Artificial Sequence; identical to SEQ ID NO: 9883
  hemagglutinin__InfluenzaA__AHZ40500

SEQ ID NO: 12217 - protein, 566 aa, Artificial Sequence; identical to SEQ ID NO: 9883
  hemagglutinin__InfluenzaA__AHZ40512

SEQ ID NO: 12218 - protein, 566 aa, Artificial Sequence
  hemagglutinin__InfluenzaA__AHZ40524
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12219 - protein, 566 aa, Artificial Sequence; identical to SEQ ID NO: 11770
  hemagglutinin__InfluenzaA__AHZ40536

SEQ ID NO: 12220 - protein, 566 aa, Artificial Sequence; identical to SEQ ID NO: 9883
  hemagglutinin__InfluenzaA__AHZ40548

SEQ ID NO: 12221 - protein, 566 aa, Artificial Sequence; identical to SEQ ID NO: 9858
  hemagglutinin__InfluenzaA__AHZ40572

SEQ ID NO: 12222 - protein, 566 aa, Artificial Sequence; identical to SEQ ID NO: 9858
  hemagglutinin__InfluenzaA__AHZ40583

SEQ ID NO: 12223 - protein, 566 aa, Artificial Sequence
  hemagglutinin__InfluenzaA__AHZ40595
MKAILVVMLYTFATANADTLCIGYHANNSTDTVDTVLEKNVTVTHSVNLLEDKHDGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPHAGAKGFYKNLIWLVKKGNSYPKLSISYINDKGKEVLVLWGIHHPSTTADQQSLYQNADTYVFVGTSRYSKKFKPEIAIRPKVRDQEGRMNYYWTLVEPGDKITFEATGNLVVPRYAFAMKRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTAASSLVLVVSLGAISFWMCSNGSLQCRICI

SEQ ID NO: 12224 - protein, 566 aa, Artificial Sequence
  hemagglutinin__InfluenzaA__AHZ40606
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12225 - protein, 566 aa, Artificial Sequence; identical to SEQ ID NO: 9883
  hemagglutinin__InfluenzaA__AHZ40618

SEQ ID NO: 12226 - protein, 566 aa, Artificial Sequence; identical to SEQ ID NO: 9922
  hemagglutinin__InfluenzaA__AHZ40626

SEQ ID NO: 12227 - protein, 566 aa, Artificial Sequence; identical to SEQ ID NO: 9883
  hemagglutinin__InfluenzaA__AHZ40638

SEQ ID NO: 12228 - protein, 566 aa, Artificial Sequence; identical to SEQ ID NO: 9858
  hemagglutinin__InfluenzaA__AHZ40650

SEQ ID NO: 12229 - protein, 566 aa, Artificial Sequence
  hemagglutinin__InfluenzaA__AHZ40662
MKTIIALSYILCLVFAQELPGNDDSTATLCLGHHAVPNGTIVKTITNDRIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTIPNNEQFDKLYIWGVHHPGTDKDQIFLYAQASGRITVSTKRSQQTVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12230 - protein, 566 aa, Artificial Sequence; identical to SEQ ID NO: 9903
  hemagglutinin__InfluenzaA__AHZ40674

SEQ ID NO: 12231 - protein, 566 aa, Artificial Sequence; identical to SEQ ID NO: 9883
  hemagglutinin__InfluenzaA__AHZ40686

SEQ ID NO: 12232 - protein, 566 aa, Artificial Sequence; identical to SEQ ID NO: 9868
  hemagglutinin__InfluenzaA__AHZ40698

SEQ ID NO: 12233 - protein, 566 aa, Artificial Sequence; identical to SEQ ID NO: 9868
  hemagglutinin__InfluenzaA__AHZ40710

SEQ ID NO: 12234 - protein, 566 aa, Artificial Sequence; identical to SEQ ID NO: 9994
  hemagglutinin__InfluenzaA__AHZ40722

SEQ ID NO: 12235 - protein, 566 aa, Artificial Sequence; identical to SEQ ID NO: 9891
  hemagglutinin__InfluenzaA__AHZ40734

SEQ ID NO: 12236 - protein, 566 aa, Artificial Sequence; identical to SEQ ID NO: 9994
  hemagglutinin__InfluenzaA__AHZ40746

SEQ ID NO: 12237 - protein, 566 aa, Artificial Sequence; identical to SEQ ID NO: 12187
  hemagglutinin__InfluenzaA__AHZ40758

SEQ ID NO: 12238 - protein, 566 aa, Artificial Sequence; identical to SEQ ID NO: 2667
  hemagglutinin__InfluenzaA__AHZ40782

SEQ ID NO: 12239 - protein, 566 aa, Artificial Sequence; identical to SEQ ID NO: 2667
  hemagglutinin__InfluenzaA__AHZ40793

SEQ ID NO: 12240 - protein, 566 aa, Artificial Sequence; identical to SEQ ID NO: 2667
  hemagglutinin__InfluenzaA__AHZ40804

SEQ ID NO: 12241 - protein, 566 aa, Artificial Sequence
  hemagglutinin__InfluenzaA__AHZ40815
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12242 - protein, 566 aa, Artificial Sequence
  hemagglutinin__InfluenzaA__AHZ40826
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSIYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12243 - protein, 566 aa, Artificial Sequence
  hemagglutinin__InfluenzaA__AHZ40848
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKEGNSYPKLSKSYINDKGKEVLVLWGIHHPSTSAEQQSLYQNADAYVFVGSSRYSKKFKPEIAARPKVRGQAGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12244 - protein, 566 aa, Artificial Sequence
  hemagglutinin__InfluenzaA__AHZ40881
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSAEQQSLYQNADAYVFVGSSRYSKKFKPEIAARPKVRGQAGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12245 - protein, 566 aa, Artificial Sequence; identical to SEQ ID NO: 12244
  hemagglutinin__InfluenzaA__AHZ40892

SEQ ID NO: 12246 - protein, 566 aa, Artificial Sequence; identical to SEQ ID NO: 12243
  hemagglutinin__InfluenzaA__AHZ40914

SEQ ID NO: 12247 - protein, 566 aa, Artificial Sequence; identical to SEQ ID NO: 12244
  hemagglutinin__InfluenzaA__AHZ40925

SEQ ID NO: 12248 - protein, 566 aa, Artificial Sequence
  hemagglutinin__InfluenzaA__AHZ40936
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSAEQQSLYQNADAYVFVGSSRYSKKFKPEIAARPKVRDQAGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12249 - protein, 566 aa, Artificial Sequence; identical to SEQ ID NO: 12243
  hemagglutinin__InfluenzaA__AHZ40947

SEQ ID NO: 12250 - protein, 566 aa, Artificial Sequence; identical to SEQ ID NO: 12244
  hemagglutinin__InfluenzaA__AHZ40958

SEQ ID NO: 12251 - protein, 566 aa, Artificial Sequence; identical to SEQ ID NO: 12248
  hemagglutinin__InfluenzaA__AHZ40969

SEQ ID NO: 12252 - protein, 566 aa, Artificial Sequence; identical to SEQ ID NO: 12248
  hemagglutinin__InfluenzaA__AHZ40980

SEQ ID NO: 12253 - protein, 566 aa, Artificial Sequence; identical to SEQ ID NO: 12248
  hemagglutinin__InfluenzaA__AHZ40991

SEQ ID NO: 12254 - protein, 566 aa, Artificial Sequence; identical to SEQ ID NO: 12248
  hemagglutinin__InfluenzaA__AHZ41002

SEQ ID NO: 12255 - protein, 566 aa, Artificial Sequence; identical to SEQ ID NO: 12248
  hemagglutinin__InfluenzaA__AHZ41013

SEQ ID NO: 12256 - protein, 566 aa, Artificial Sequence; identical to SEQ ID NO: 12244
  hemagglutinin__InfluenzaA__AHZ41024

SEQ ID NO: 12257 - protein, 566 aa, Artificial Sequence; identical to SEQ ID NO: 12244
  hemagglutinin__InfluenzaA__AHZ41035

SEQ ID NO: 12258 - protein, 566 aa, Artificial Sequence; identical to SEQ ID NO: 12244
  hemagglutinin__InfluenzaA__AHZ41046

SEQ ID NO: 12259 - protein, 566 aa, Artificial Sequence; identical to SEQ ID NO: 12244
  hemagglutinin__InfluenzaA__AHZ41057

SEQ ID NO: 12260 - protein, 566 aa, Artificial Sequence; identical to SEQ ID NO: 12244
  hemagglutinin__InfluenzaA__AHZ41068

SEQ ID NO: 12261 - protein, 566 aa, Artificial Sequence; identical to SEQ ID NO: 12248
  hemagglutinin__InfluenzaA__AHZ41079

SEQ ID NO: 12262 - protein, 566 aa, Artificial Sequence; identical to SEQ ID NO: 12244
  hemagglutinin__InfluenzaA__AHZ41090

SEQ ID NO: 12263 - protein, 566 aa, Artificial Sequence; identical to SEQ ID NO: 12248
  hemagglutinin__InfluenzaA__AHZ41101

SEQ ID NO: 12264 - protein, 566 aa, Artificial Sequence; identical to SEQ ID NO: 12244
  hemagglutinin__InfluenzaA__AHZ41112

SEQ ID NO: 12265 - protein, 566 aa, Artificial Sequence; identical to SEQ ID NO: 12244
  hemagglutinin__InfluenzaA__AHZ41123

SEQ ID NO: 12266 - protein, 566 aa, Artificial Sequence; identical to SEQ ID NO: 12244
  hemagglutinin__InfluenzaA__AHZ41134

SEQ ID NO: 12267 - protein, 566 aa, Artificial Sequence; identical to SEQ ID NO: 12244
  hemagglutinin__InfluenzaA__AHZ41145

SEQ ID NO: 12268 - protein, 566 aa, Artificial Sequence; identical to SEQ ID NO: 12244
  hemagglutinin__InfluenzaA__AHZ41156

SEQ ID NO: 12269 - protein, 566 aa, Artificial Sequence; identical to SEQ ID NO: 12244
  hemagglutinin__InfluenzaA__AHZ41167

SEQ ID NO: 12270 - protein, 566 aa, Artificial Sequence; identical to SEQ ID NO: 12244
  hemagglutinin__InfluenzaA__AHZ41178

SEQ ID NO: 12271 - protein, 566 aa, Artificial Sequence; identical to SEQ ID NO: 12244
  hemagglutinin__InfluenzaA__AHZ41189

SEQ ID NO: 12272 - protein, 566 aa, Artificial Sequence; identical to SEQ ID NO: 12243
  hemagglutinin__InfluenzaA__AHZ41246

SEQ ID NO: 12273 - protein, 566 aa, Artificial Sequence; identical to SEQ ID NO: 12248
  hemagglutinin__InfluenzaA__AHZ41263

SEQ ID NO: 12274 - protein, 566 aa, Artificial Sequence; identical to SEQ ID NO: 12244
  hemagglutinin__InfluenzaA__AHZ41281

SEQ ID NO: 12275 - protein, 566 aa, Artificial Sequence; identical to SEQ ID NO: 12244
  hemagglutinin__InfluenzaA__AHZ41292

SEQ ID NO: 12276 - protein, 566 aa, Artificial Sequence; identical to SEQ ID NO: 12243
  hemagglutinin__InfluenzaA__AHZ41303

SEQ ID NO: 12277 - protein, 566 aa, Artificial Sequence; identical to SEQ ID NO: 12243
  hemagglutinin__InfluenzaA__AHZ41314

SEQ ID NO: 12278 - protein, 566 aa, Artificial Sequence; identical to SEQ ID NO: 12243
  hemagglutinin__InfluenzaA__AHZ41325

SEQ ID NO: 12279 - protein, 566 aa, Artificial Sequence; identical to SEQ ID NO: 12243
  hemagglutinin__InfluenzaA__AHZ41336

SEQ ID NO: 12280 - protein, 566 aa, Artificial Sequence; identical to SEQ ID NO: 12243
  hemagglutinin__InfluenzaA__AHZ41347

SEQ ID NO: 12281 - protein, 566 aa, Artificial Sequence; identical to SEQ ID NO: 12244
  hemagglutinin__InfluenzaA__AHZ41358

SEQ ID NO: 12282 - protein, 566 aa, Artificial Sequence; identical to SEQ ID NO: 12244
  hemagglutinin__InfluenzaA__AHZ41366

SEQ ID NO: 12283 - protein, 566 aa, Artificial Sequence; identical to SEQ ID NO: 12248
  hemagglutinin__InfluenzaA__AHZ41377

SEQ ID NO: 12284 - protein, 566 aa, Artificial Sequence; identical to SEQ ID NO: 12244
  hemagglutinin__InfluenzaA__AHZ41388

SEQ ID NO: 12285 - protein, 566 aa, Artificial Sequence; identical to SEQ ID NO: 12248
  hemagglutinin__InfluenzaA__AHZ41410

SEQ ID NO: 12286 - protein, 566 aa, Artificial Sequence; identical to SEQ ID NO: 12244
  hemagglutinin__InfluenzaA__AHZ41432

SEQ ID NO: 12287 - protein, 566 aa, Artificial Sequence
  hemagglutinin__InfluenzaA__AHZ41441
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKEGNSYPKLSKSYINDKGKEVLVLWGIHHPSTSAEQQSLYQNADAYVFVGSSRYSKKFKPEIAARPKVRDQAGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12288 - protein, 566 aa, Artificial Sequence; identical to SEQ ID NO: 12243
  hemagglutinin__InfluenzaA__AHZ41452

SEQ ID NO: 12289 - protein, 566 aa, Artificial Sequence
  hemagglutinin__InfluenzaA__AHZ41463
MKAILVVLLYTFATANADTLCIGYHANNSTDTVYTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSAEQQSLYQNADAYVFVGSSRYSKKFKPEIAARPKVRGQAGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12290 - protein, 566 aa, Artificial Sequence; identical to SEQ ID NO: 12243
  hemagglutinin__InfluenzaA__AHZ41473

SEQ ID NO: 12291 - protein, 566 aa, Artificial Sequence; identical to SEQ ID NO: 12243
  hemagglutinin__InfluenzaA__AHZ41484

SEQ ID NO: 12292 - protein, 566 aa, Artificial Sequence; identical to SEQ ID NO: 12248
  hemagglutinin__InfluenzaA__AHZ41495

SEQ ID NO: 12293 - protein, 566 aa, Artificial Sequence; identical to SEQ ID NO: 12243
  hemagglutinin__InfluenzaA__AHZ41506

SEQ ID NO: 12294 - protein, 566 aa, Artificial Sequence
  hemagglutinin__InfluenzaA__AHZ41517
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSESYINDKGKEVLVLWGIHHPSTSAEQQSLYQNADAYVFVGSSRYSKKFKPEIAARPKVRGQAGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12295 - protein, 566 aa, Artificial Sequence
  hemagglutinin__InfluenzaA__AHZ41528
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSESYINDKGKEVLVLWGIHHPSTSADQQSLYQNADAYVFVGSSRYSKKFKPEIAARPKVRGQAGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12296 - protein, 566 aa, Artificial Sequence; identical to SEQ ID NO: 12248
  hemagglutinin__InfluenzaA__AHZ41539

SEQ ID NO: 12297 - protein, 566 aa, Artificial Sequence; identical to SEQ ID NO: 12243
  hemagglutinin__InfluenzaA__AHZ41550

SEQ ID NO: 12298 - protein, 566 aa, Artificial Sequence; identical to SEQ ID NO: 12244
  hemagglutinin__InfluenzaA__AHZ41561

SEQ ID NO: 12299 - protein, 566 aa, Artificial Sequence
  hemagglutinin__InfluenzaA__AHZ41572
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSAEQQSLYQNADAYVFVGSSRYSKKFKPEIAARPKVRGQAGRMNYYWTLVEPGDEITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12300 - protein, 566 aa, Artificial Sequence; identical to SEQ ID NO: 12248
  hemagglutinin__InfluenzaA__AHZ41583

SEQ ID NO: 12301 - protein, 566 aa, Artificial Sequence; identical to SEQ ID NO: 12243
  hemagglutinin__InfluenzaA__AHZ41594

SEQ ID NO: 12302 - protein, 566 aa, Artificial Sequence
  hemagglutinin__InfluenzaA__AHZ41605
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPNTSSWPNHDSNKGVTAACPHAGAKSFYKNLIWLVKKGNSYPKLSKSYINDKGKEVLVLWGIHHPSTSAEQQSLYQNADAYVFVGSSRYSKKFKPEIAARPKVMGQAGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12303 - protein, 566 aa, Artificial Sequence; identical to SEQ ID NO: 12243
  hemagglutinin__InfluenzaA__AHZ41616

SEQ ID NO: 12304 - protein, 566 aa, Artificial Sequence; identical to SEQ ID NO: 12248
  hemagglutinin__InfluenzaA__AHZ41627

SEQ ID NO: 12305 - protein, 566 aa, Artificial Sequence; identical to SEQ ID NO: 12248
  hemagglutinin__InfluenzaA__AHZ41638

SEQ ID NO: 12306 - protein, 566 aa, Artificial Sequence; identical to SEQ ID NO: 12244
  hemagglutinin__InfluenzaA__AHZ41649

SEQ ID NO: 12307 - protein, 566 aa, Artificial Sequence; identical to SEQ ID NO: 12244
  hemagglutinin__InfluenzaA__AHZ41660

SEQ ID NO: 12308 - protein, 566 aa, Artificial Sequence; identical to SEQ ID NO: 12248
  hemagglutinin__InfluenzaA__AHZ41671

SEQ ID NO: 12309 - protein, 566 aa, Artificial Sequence; identical to SEQ ID NO: 12248
  hemagglutinin__InfluenzaA__AHZ41682

SEQ ID NO: 12310 - protein, 566 aa, Artificial Sequence; identical to SEQ ID NO: 12248
  hemagglutinin__InfluenzaA__AHZ41693

SEQ ID NO: 12311 - protein, 566 aa, Artificial Sequence; identical to SEQ ID NO: 12248
  hemagglutinin__InfluenzaA__AHZ41704

SEQ ID NO: 12312 - protein, 566 aa, Artificial Sequence; identical to SEQ ID NO: 12248
  hemagglutinin__InfluenzaA__AHZ41715

SEQ ID NO: 12313 - protein, 566 aa, Artificial Sequence; identical to SEQ ID NO: 12248
  hemagglutinin__InfluenzaA__AHZ41726

SEQ ID NO: 12314 - protein, 566 aa, Artificial Sequence; identical to SEQ ID NO: 12248
  hemagglutinin__InfluenzaA__AHZ41737

SEQ ID NO: 12315 - protein, 566 aa, Artificial Sequence; identical to SEQ ID NO: 12248
  hemagglutinin__InfluenzaA__AHZ41748

SEQ ID NO: 12316 - protein, 566 aa, Artificial Sequence; identical to SEQ ID NO: 12248
  hemagglutinin__InfluenzaA__AHZ41759

SEQ ID NO: 12317 - protein, 566 aa, Artificial Sequence; identical to SEQ ID NO: 10075
  hemagglutinin__InfluenzaA__AHZ42561

SEQ ID NO: 12318 - protein, 566 aa, Artificial Sequence
  hemagglutinin__InfluenzaA__AHZ42572
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMDKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12319 - protein, 566 aa, Artificial Sequence; identical to SEQ ID NO: 11786
  hemagglutinin__InfluenzaA__AHZ42584

SEQ ID NO: 12320 - protein, 566 aa, Artificial Sequence; identical to SEQ ID NO: 9883
  hemagglutinin__InfluenzaA__AHZ42596

SEQ ID NO: 12321 - protein, 566 aa, Artificial Sequence; identical to SEQ ID NO: 10060
  hemagglutinin__InfluenzaA__AHZ42608

SEQ ID NO: 12322 - protein, 566 aa, Artificial Sequence; identical to SEQ ID NO: 9883
  hemagglutinin__InfluenzaA__AHZ42619

SEQ ID NO: 12323 - protein, 566 aa, Artificial Sequence
  hemagglutinin__InfluenzaA__AHZ42631
MKTIIALSYILCLVFAQKLPGNYNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12324 - protein, 566 aa, Artificial Sequence
  hemagglutinin__InfluenzaA__AHZ42643
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSGSDNGTCYPGDFIDYEELREQLSSVSSFERFEIFPKASSWPNHDSNKGVTAACPHAGAKGFYKNLIWLVKKGNSYPKLSISYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTAASSLVLVVSLGAISFWMCSNGSLQCRICI

SEQ ID NO: 12325 - protein, 566 aa, Artificial Sequence; identical to SEQ ID NO: 9883
  hemagglutinin__InfluenzaA__AHZ42654

SEQ ID NO: 12326 - protein, 566 aa, Artificial Sequence; identical to SEQ ID NO: 9858
  hemagglutinin__InfluenzaA__AHZ42666

SEQ ID NO: 12327 - protein, 566 aa, Artificial Sequence; identical to SEQ ID NO: 9858
  hemagglutinin__InfluenzaA__AHZ42678

SEQ ID NO: 12328 - protein, 566 aa, Artificial Sequence
  hemagglutinin__InfluenzaA__AHZ42690
MKAILVVLLYTYATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTTDQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12329 - protein, 566 aa, Artificial Sequence; identical to SEQ ID NO: 9883
  hemagglutinin__InfluenzaA__AHZ42701

SEQ ID NO: 12330 - protein, 566 aa, Artificial Sequence; identical to SEQ ID NO: 9858
  hemagglutinin__InfluenzaA__AHZ42713

SEQ ID NO: 12331 - protein, 566 aa, Artificial Sequence
  hemagglutinin__InfluenzaA__AHZ42725
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRNGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12332 - protein, 566 aa, Artificial Sequence
  hemagglutinin__InfluenzaA__AHZ42737
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLIEPGDKITFEATGNLVVPRYAFAMERNAESGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12333 - protein, 566 aa, Artificial Sequence; identical to SEQ ID NO: 9883
  hemagglutinin__InfluenzaA__AHZ42748

SEQ ID NO: 12334 - protein, 566 aa, Artificial Sequence; identical to SEQ ID NO: 9903
  hemagglutinin__InfluenzaA__AHZ42760

SEQ ID NO: 12335 - protein, 566 aa, Artificial Sequence
  hemagglutinin__InfluenzaA__AHZ42772
MKTIIALSYILCLVFAQELPGNDDSTATLCLGHHAVPNGTIVKTITNDRIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQTVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKEVELKSGYKDWILWISFAISCFLLCVALLGFIMWACQKGNIRCNICI

SEQ ID NO: 12336 - protein, 566 aa, Artificial Sequence; identical to SEQ ID NO: 9883
  hemagglutinin__InfluenzaA__AHZ42784

SEQ ID NO: 12337 - protein, 566 aa, Artificial Sequence; identical to SEQ ID NO: 9858
  hemagglutinin__InfluenzaA__AHZ42796

SEQ ID NO: 12338 - protein, 566 aa, Artificial Sequence; identical to SEQ ID NO: 9858
  hemagglutinin__InfluenzaA__AHZ42808

SEQ ID NO: 12339 - protein, 566 aa, Artificial Sequence; identical to SEQ ID NO: 12332
  hemagglutinin__InfluenzaA__AHZ42820

SEQ ID NO: 12340 - protein, 566 aa, Artificial Sequence; identical to SEQ ID NO: 10467
  hemagglutinin__InfluenzaA__AHZ42831

SEQ ID NO: 12341 - protein, 566 aa, Artificial Sequence
  hemagglutinin__InfluenzaA__AHZ42843
MKTIIALSYILCLVFAQKLPGNDNSTATLCLGHHAVPNGTMVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12342 - protein, 566 aa, Artificial Sequence
  hemagglutinin__InfluenzaA__AHZ42855
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNMTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12343 - protein, 566 aa, Artificial Sequence
  hemagglutinin__InfluenzaA__AHZ42867
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSEYKDWILWISFAISCFLLCVALLGFIMWACQKGNIRCNICI

SEQ ID NO: 12344 - protein, 566 aa, Artificial Sequence; identical to SEQ ID NO: 9858
  hemagglutinin__InfluenzaA__AHZ42879

SEQ ID NO: 12345 - protein, 566 aa, Artificial Sequence
  hemagglutinin__InfluenzaA__AHZ42891
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSSCYPYDVPDYASLRSLVASSGTLEFNNESFNWAGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12346 - protein, 566 aa, Artificial Sequence
  hemagglutinin__InfluenzaA__AHZ42903
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12347 - protein, 566 aa, Artificial Sequence; identical to SEQ ID NO: 9835
  hemagglutinin__InfluenzaA__AHZ42915

SEQ ID NO: 12348 - protein, 560 aa, Artificial Sequence; identical to SEQ ID NO: 9988
  hemagglutinin__InfluenzaA__AHZ59747

SEQ ID NO: 12349 - protein, 560 aa, Artificial Sequence
  hemagglutinin__InfluenzaA__AHZ59759
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKSREEAMQNRIQIDPVKLSSGYKDVILWFSFGASCFILLAIVMGLVFICVKNGNMRCTICI

SEQ ID NO: 12350 - protein, 560 aa, Artificial Sequence
  hemagglutinin__InfluenzaA__AHZ59771
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 12351 - protein, 560 aa, Artificial Sequence
  hemagglutinin__InfluenzaA__AHZ59795
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGTTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 12352 - protein, 560 aa, Artificial Sequence; identical to SEQ ID NO: 12351
  hemagglutinin__InfluenzaA__AHZ59807

SEQ ID NO: 12353 - protein, 560 aa, Artificial Sequence; identical to SEQ ID NO: 12351
  hemagglutinin__InfluenzaA__AHZ59819

SEQ ID NO: 12354 - protein, 560 aa, Artificial Sequence; identical to SEQ ID NO: 9988
  hemagglutinin__InfluenzaA__AHZ59831

SEQ ID NO: 12355 - protein, 560 aa, Artificial Sequence; identical to SEQ ID NO: 9988
  hemagglutinin__InfluenzaA__AHZ59843

SEQ ID NO: 12356 - protein, 560 aa, Artificial Sequence; identical to SEQ ID NO: 9988
  hemagglutinin__InfluenzaA__AHZ59855

SEQ ID NO: 12357 - protein, 560 aa, Artificial Sequence; identical to SEQ ID NO: 12350
  hemagglutinin__InfluenzaA__AHZ59867

SEQ ID NO: 12358 - protein, 560 aa, Artificial Sequence; identical to SEQ ID NO: 9988
  hemagglutinin__InfluenzaA__AHZ59879

SEQ ID NO: 12359 - protein, 560 aa, Artificial Sequence; identical to SEQ ID NO: 12350
  hemagglutinin__InfluenzaA__AHZ59915

SEQ ID NO: 12360 - protein, 560 aa, Artificial Sequence; identical to SEQ ID NO: 9988
  hemagglutinin__InfluenzaA__AHZ59927

SEQ ID NO: 12361 - protein, 560 aa, Artificial Sequence; identical to SEQ ID NO: 12350
  hemagglutinin__InfluenzaA__AHZ59939

SEQ ID NO: 12362 - protein, 560 aa, Artificial Sequence; identical to SEQ ID NO: 9988
  hemagglutinin__InfluenzaA__AHZ59951

SEQ ID NO: 12363 - protein, 560 aa, Artificial Sequence; identical to SEQ ID NO: 9988
  hemagglutinin__InfluenzaA__AHZ59963

SEQ ID NO: 12364 - protein, 560 aa, Artificial Sequence; identical to SEQ ID NO: 9988
  hemagglutinin__InfluenzaA__AHZ59988

SEQ ID NO: 12365 - protein, 560 aa, Artificial Sequence; identical to SEQ ID NO: 9988
  hemagglutinin__InfluenzaA__AHZ60000

SEQ ID NO: 12366 - protein, 560 aa, Artificial Sequence; identical to SEQ ID NO: 9988
  hemagglutinin__InfluenzaA__AHZ60012

SEQ ID NO: 12367 - protein, 560 aa, Artificial Sequence; identical to SEQ ID NO: 9988
  hemagglutinin__InfluenzaA__AHZ60024

SEQ ID NO: 12368 - protein, 560 aa, Artificial Sequence; identical to SEQ ID NO: 12351
  hemagglutinin__InfluenzaA__AHZ60036

SEQ ID NO: 12369 - protein, 560 aa, Artificial Sequence; identical to SEQ ID NO: 12351
  hemagglutinin__InfluenzaA__AHZ60048

SEQ ID NO: 12370 - protein, 560 aa, Artificial Sequence; identical to SEQ ID NO: 12351
  hemagglutinin__InfluenzaA__AHZ60060

SEQ ID NO: 12371 - protein, 560 aa, Artificial Sequence; identical to SEQ ID NO: 12351
  hemagglutinin__InfluenzaA__AHZ60072

SEQ ID NO: 12372 - protein, 560 aa, Artificial Sequence; identical to SEQ ID NO: 12351
  hemagglutinin__InfluenzaA__AHZ60084

SEQ ID NO: 12373 - protein, 560 aa, Artificial Sequence
  hemagglutinin__InfluenzaA__AHZ60096
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDDAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 12374 - protein, 566 aa, Artificial Sequence
  hemagglutinin__InfluenzaA__AIC64889
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKENSYPKLSKSYINDKGKEVLVLWGIHHPSTSADQQSLYQNADAYVFVGSSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12375 - protein, 566 aa, Artificial Sequence; identical to SEQ ID NO: 10040
  hemagglutinin__InfluenzaA__AIC73738

SEQ ID NO: 12376 - protein, 566 aa, Artificial Sequence
  hemagglutinin__InfluenzaA__AIC73739
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERHAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12377 - protein, 566 aa, Artificial Sequence
  hemagglutinin__InfluenzaA__AIC73740
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPPTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLDREKIDGVRLESTRIYQILAIYSTVASSLVLVVSLGAISFWMCSNGSLQCRICI

SEQ ID NO: 12378 - protein, 566 aa, Artificial Sequence
  hemagglutinin__InfluenzaA__AIC73741
MKTIIALSYILCLVFAQKLPGNDNSTATLCLGHHAVPNGTIVKTITNDRIEVTNATELVQNSSIGEICDSPHQILDGENCTLIDALLGDPHCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHRCDNACIGSIRNGTYDHNVYRDEALNNRFQIRGVELKSGYKDWILWISFAISCFLLCVALLGFIMWACQKGNIRCNICI

SEQ ID NO: 12379 - protein, 566 aa, Artificial Sequence
  hemagglutinin__InfluenzaA__AIC73742
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLRQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNRKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12380 - protein, 566 aa, Artificial Sequence; identical to SEQ ID NO: 12379
  hemagglutinin__InfluenzaA__AIC73743

SEQ ID NO: 12381 - protein, 566 aa, Artificial Sequence
  hemagglutinin__InfluenzaA__AIC73744
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPAHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12382 - protein, 566 aa, Artificial Sequence
  hemagglutinin__InfluenzaA__AIC73745
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWALVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12383 - protein, 566 aa, Artificial Sequence
  hemagglutinin__InfluenzaA__AIC73746
MKAILVVLLYTFATANADTLCIGYHANNSTDTVDTVLEKNVTVTHSVNLLEDKHNGKLCKLRGVTPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12384 - protein, 566 aa, Artificial Sequence
  hemagglutinin__InfluenzaA__AIC73747
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNTGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12385 - protein, 566 aa, Artificial Sequence; identical to SEQ ID NO: 10040
  hemagglutinin__InfluenzaA__AIC73748

SEQ ID NO: 12386 - protein, 566 aa, Artificial Sequence
  hemagglutinin__InfluenzaA__AIC73749
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKRWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAHSSGRITVSTKRSQQAVIPNIGSRPRIRNIPSRISIYWTIVKPGDILLINSTGNLIAPRGYFKIQSGKSSIMRSDAPIGKCKSECITPNGSITNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12387 - protein, 566 aa, Artificial Sequence; identical to SEQ ID NO: 10040
  hemagglutinin__InfluenzaA__AIC73750

SEQ ID NO: 12388 - protein, 566 aa, Artificial Sequence
  hemagglutinin__InfluenzaA__AIC73754
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSRKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12389 - protein, 566 aa, Artificial Sequence; identical to SEQ ID NO: 10040
  hemagglutinin__InfluenzaA__AIC73755

SEQ ID NO: 12390 - protein, 566 aa, Artificial Sequence; identical to SEQ ID NO: 10040
  hemagglutinin__InfluenzaA__AIC73756

SEQ ID NO: 12391 - protein, 566 aa, Artificial Sequence; identical to SEQ ID NO: 10040
  hemagglutinin__InfluenzaA__AIC73757

SEQ ID NO: 12392 - protein, 566 aa, Artificial Sequence
  hemagglutinin__InfluenzaA__AIC73758
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12393 - protein, 566 aa, Artificial Sequence
  hemagglutinin__InfluenzaA__AIC73760
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12394 - protein, 566 aa, Artificial Sequence; identical to SEQ ID NO: 12393
  hemagglutinin__InfluenzaA__AIC73761

SEQ ID NO: 12395 - protein, 566 aa, Artificial Sequence; identical to SEQ ID NO: 11920
  hemagglutinin__InfluenzaA__AIC73762

SEQ ID NO: 12396 - protein, 566 aa, Artificial Sequence
  hemagglutinin__InfluenzaA__AIC73763
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKISQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12397 - protein, 566 aa, Artificial Sequence; identical to SEQ ID NO: 10040
  hemagglutinin__InfluenzaA__AIC73765

SEQ ID NO: 12398 - protein, 566 aa, Artificial Sequence; identical to SEQ ID NO: 10040
  hemagglutinin__InfluenzaA__AIC73766

SEQ ID NO: 12399 - protein, 566 aa, Artificial Sequence
  hemagglutinin__InfluenzaA__AIC73767
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLIKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKIRNQLKNNAKEIGNGCFEFYHKCDNMCMESVKNGTYDYPKYSEEAKLNREKIDGVKLESTRIYQILAIYSTVASSLVLVVSLGAISFWMCSNGSLQCRICI

SEQ ID NO: 12400 - protein, 566 aa, Artificial Sequence; identical to SEQ ID NO: 10040
  hemagglutinin__InfluenzaA__AIC73768

SEQ ID NO: 12401 - protein, 566 aa, Artificial Sequence; identical to SEQ ID NO: 10040
  hemagglutinin__InfluenzaA__AIC73769

SEQ ID NO: 12402 - protein, 566 aa, Artificial Sequence; identical to SEQ ID NO: 10040
  hemagglutinin__InfluenzaA__AIC73770

SEQ ID NO: 12403 - protein, 566 aa, Artificial Sequence; identical to SEQ ID NO: 10040
  hemagglutinin__InfluenzaA__AIC73771

SEQ ID NO: 12404 - protein, 566 aa, Artificial Sequence
  hemagglutinin__InfluenzaA__AIC73772
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRVYQILAIYSTVASSLVLVVSLGAISFWMCSNGSLQCRICI

SEQ ID NO: 12405 - protein, 566 aa, Artificial Sequence; identical to SEQ ID NO: 10040
  hemagglutinin__InfluenzaA__AIC73773

SEQ ID NO: 12406 - protein, 566 aa, Artificial Sequence; identical to SEQ ID NO: 10040
  hemagglutinin__InfluenzaA__AIC73775

SEQ ID NO: 12407 - protein, 566 aa, Artificial Sequence; identical to SEQ ID NO: 10040
  hemagglutinin__InfluenzaA__AIC73776

SEQ ID NO: 12408 - protein, 566 aa, Artificial Sequence; identical to SEQ ID NO: 12404
  hemagglutinin__InfluenzaA__AIC73777

SEQ ID NO: 12409 - protein, 566 aa, Artificial Sequence
  hemagglutinin__InfluenzaA__AIC73778
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAHSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12410 - protein, 566 aa, Artificial Sequence; identical to SEQ ID NO: 12409
  hemagglutinin__InfluenzaA__AIC73779

SEQ ID NO: 12411 - protein, 566 aa, Artificial Sequence; identical to SEQ ID NO: 12409
  hemagglutinin__InfluenzaA__AIC73780

SEQ ID NO: 12412 - protein, 566 aa, Artificial Sequence; identical to SEQ ID NO: 10998
  hemagglutinin__InfluenzaA__AIC73781

SEQ ID NO: 12413 - protein, 566 aa, Artificial Sequence; identical to SEQ ID NO: 12409
  hemagglutinin__InfluenzaA__AIC73782

SEQ ID NO: 12414 - protein, 566 aa, Artificial Sequence; identical to SEQ ID NO: 12409
  hemagglutinin__InfluenzaA__AIC73783

SEQ ID NO: 12415 - protein, 566 aa, Artificial Sequence; identical to SEQ ID NO: 12409
  hemagglutinin__InfluenzaA__AIC73784

SEQ ID NO: 12416 - protein, 566 aa, Artificial Sequence; identical to SEQ ID NO: 10040
  hemagglutinin__InfluenzaA__AIC73785

SEQ ID NO: 12417 - protein, 566 aa, Artificial Sequence; identical to SEQ ID NO: 12409
  hemagglutinin__InfluenzaA__AIC73786

SEQ ID NO: 12418 - protein, 566 aa, Artificial Sequence; identical to SEQ ID NO: 10040
  hemagglutinin__InfluenzaA__AIC73787

SEQ ID NO: 12419 - protein, 566 aa, Artificial Sequence; identical to SEQ ID NO: 10040
  hemagglutinin__InfluenzaA__AIC73788

SEQ ID NO: 12420 - protein, 566 aa, Artificial Sequence
  hemagglutinin__InfluenzaA__AIC73789
MKTIIALSYILCLVFAQKPPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12421 - protein, 566 aa, Artificial Sequence
  hemagglutinin__InfluenzaA__AIC73790
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLRQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12422 - protein, 566 aa, Artificial Sequence
  hemagglutinin__InfluenzaA__AIC73791
MKAILVVLLYTFATANADTLCIGYHANNSTDTIDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12423 - protein, 566 aa, Artificial Sequence; identical to SEQ ID NO: 10040
  hemagglutinin__InfluenzaA__AIC73792

SEQ ID NO: 12424 - protein, 566 aa, Artificial Sequence; identical to SEQ ID NO: 12404
  hemagglutinin__InfluenzaA__AIC73793

SEQ ID NO: 12425 - protein, 566 aa, Artificial Sequence
  hemagglutinin__InfluenzaA__AIC73794
MKTIIGVSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12426 - protein, 566 aa, Artificial Sequence; identical to SEQ ID NO: 10040
  hemagglutinin__InfluenzaA__AIC73796

SEQ ID NO: 12427 - protein, 566 aa, Artificial Sequence
  hemagglutinin__InfluenzaA__AIC73797
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12428 - protein, 566 aa, Artificial Sequence; identical to SEQ ID NO: 12427
  hemagglutinin__InfluenzaA__AIC73798

SEQ ID NO: 12429 - protein, 566 aa, Artificial Sequence; identical to SEQ ID NO: 12427
  hemagglutinin__InfluenzaA__AIC73800

SEQ ID NO: 12430 - protein, 566 aa, Artificial Sequence; identical to SEQ ID NO: 12427
  hemagglutinin__InfluenzaA__AIC73801

SEQ ID NO: 12431 - protein, 566 aa, Artificial Sequence; identical to SEQ ID NO: 12427
  hemagglutinin__InfluenzaA__AIC73802

SEQ ID NO: 12432 - protein, 566 aa, Artificial Sequence; identical to SEQ ID NO: 12427
  hemagglutinin__InfluenzaA__AIC73803

SEQ ID NO: 12433 - protein, 566 aa, Artificial Sequence; identical to SEQ ID NO: 12427
  hemagglutinin__InfluenzaA__AIC73804

SEQ ID NO: 12434 - protein, 566 aa, Artificial Sequence; identical to SEQ ID NO: 12427
  hemagglutinin__InfluenzaA__AIC73805

SEQ ID NO: 12435 - protein, 566 aa, Artificial Sequence; identical to SEQ ID NO: 12427
  hemagglutinin__InfluenzaA__AIC73806

SEQ ID NO: 12436 - protein, 566 aa, Artificial Sequence
  hemagglutinin__InfluenzaA__AIC73807
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINNKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12437 - protein, 566 aa, Artificial Sequence; identical to SEQ ID NO: 12427
  hemagglutinin__InfluenzaA__AIC73808

SEQ ID NO: 12438 - protein, 566 aa, Artificial Sequence
  hemagglutinin__InfluenzaA__AIC73809
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLRQSYINDKGKEVLVLWGIHHPSTTTDQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDEVKLESTRIYQILAIYSTVASSLVLVVSLGAISFWMCSNGSLQCRICI

SEQ ID NO: 12439 - protein, 566 aa, Artificial Sequence
  hemagglutinin__InfluenzaA__AIC73810
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHRCDNTCMESVKNGTYDYPKYSEEAKLNREKIDGVKLESTRIYQILAIYSTVASSLVLVVSLGAISFWMCSNGSLQCRICI

SEQ ID NO: 12440 - protein, 566 aa, Artificial Sequence
  hemagglutinin__InfluenzaA__AIC73813
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTAASSLVLVISLGAISFWMCSNGSLQCRICI

SEQ ID NO: 12441 - protein, 566 aa, Artificial Sequence
  hemagglutinin__InfluenzaA__AIC73815
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12442 - protein, 566 aa, Artificial Sequence; identical to SEQ ID NO: 11920
  hemagglutinin__InfluenzaA__AIC73817

SEQ ID NO: 12443 - protein, 566 aa, Artificial Sequence; identical to SEQ ID NO: 10040
  hemagglutinin__InfluenzaA__AIC73819

SEQ ID NO: 12444 - protein, 566 aa, Artificial Sequence
  hemagglutinin__InfluenzaA__AIC73820
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYIEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12445 - protein, 566 aa, Artificial Sequence; identical to SEQ ID NO: 10040
  hemagglutinin__InfluenzaA__AIC73821

SEQ ID NO: 12446 - protein, 566 aa, Artificial Sequence; identical to SEQ ID NO: 12404
  hemagglutinin__InfluenzaA__AIC73824

SEQ ID NO: 12447 - protein, 566 aa, Artificial Sequence; identical to SEQ ID NO: 10040
  hemagglutinin__InfluenzaA__AIC73825

SEQ ID NO: 12448 - protein, 566 aa, Artificial Sequence
  hemagglutinin__InfluenzaA__AIC73827
MKAILVVLLYTFATANADTLCIGYHANNSTDTVDTVLEKNVTVTHSVNLLEDKHNGKLCKLRGVAPLHLGKCNIAGWILGNPECEPLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLILVVSLGAISFWMCSNGSLQCRICI

SEQ ID NO: 12449 - protein, 566 aa, Artificial Sequence
  hemagglutinin__InfluenzaA__AIC73828
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKTNAKEIGNGCFEFYHKCDNTCMESVKNGTYDYPKYSEEAKLNREKIDGVKLESTRIYQILAIYSTAASSLVLVVSLGAISFWMCSNGSLQCRICI

SEQ ID NO: 12450 - protein, 566 aa, Artificial Sequence
  hemagglutinin__InfluenzaA__AIC73830
MKAILVVLLYTFATANADTLCIGYHANNSTDTVDTVLEKNVTVTHSVNLLEDKHNGKLCKLKGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12451 - protein, 566 aa, Artificial Sequence
  hemagglutinin__InfluenzaA__AIC73833
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTAASSLVLVVSLGAISFWMCSNGSLQCRICI

SEQ ID NO: 12452 - protein, 566 aa, Artificial Sequence
  hemagglutinin__InfluenzaA__AIC73834
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHDGAKSFYKNLIWLVKKGNSYPKLSQSYINDKGKEVLVLWGIHHPSTTAGQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12453 - protein, 566 aa, Artificial Sequence
  hemagglutinin__InfluenzaA__AIC73835
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLIEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISLWMCSNGSLQCRICI

SEQ ID NO: 12454 - protein, 566 aa, Artificial Sequence; identical to SEQ ID NO: 12396
  hemagglutinin__InfluenzaA__AIC73836

SEQ ID NO: 12455 - protein, 566 aa, Artificial Sequence
  hemagglutinin__InfluenzaA__AIC73837
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12456 - protein, 566 aa, Artificial Sequence
  hemagglutinin__InfluenzaA__AIC73838
MKTIIALSYILCLVFAQKLPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDLGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12457 - protein, 566 aa, Artificial Sequence
  hemagglutinin__InfluenzaA__AIC73839
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPDHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12458 - protein, 566 aa, Artificial Sequence; identical to SEQ ID NO: 10040
  hemagglutinin__InfluenzaA__AIC73840

SEQ ID NO: 12459 - protein, 566 aa, Artificial Sequence
  hemagglutinin__InfluenzaA__AIC73841
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTIADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12460 - protein, 566 aa, Artificial Sequence; identical to SEQ ID NO: 12455
  hemagglutinin__InfluenzaA__AIC73842

SEQ ID NO: 12461 - protein, 568 aa, Artificial Sequence
  hemagglutinin__InfluenzaA__AID48082
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNHLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGIYQILSIYSTVASSLALAIMVAGLSLWMCSNGSLQCRICI

SEQ ID NO: 12462 - protein, 566 aa, Artificial Sequence
  hemagglutinin__InfluenzaA__AID70444
MKAVLVVLLYTFATANADTLCIGYHANNSTDTVDTVLEKNVTVTHSVNLLEDKHNGKLCKLRGVAPLHLGKCNIAGWILGNPECESLATASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGREVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVVLENERTLEYHDSNVKNLYEKVRSQVKNNAKEIGNGCFEFYHKCDNTCMESVKNGTYDYPKYSEEAKLNREEIDGVKLESTRIYQILAIYSTVASSLVLVVSLGAISFWMCFNGSLQCRIYI

SEQ ID NO: 12463 - protein, 566 aa, Artificial Sequence
  hemagglutinin__InfluenzaA__AID70445
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVVLENERTLEYHDSNVKNLYEKVRNQLKNNAKEIGNGCFEFYHKCDNTCMESVKNGIYDYPKYSEEAKLNREEIDGVKLESTRIYQILAIYSTVASSLVQVVSLGAISFWMCFNGSLQCRICI

SEQ ID NO: 12464 - protein, 566 aa, Artificial Sequence
  hemagglutinin__InfluenzaA__AID70446
MKAVLVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTTADQQSLYQNADTYVFVGTSRYSKKFKPEIAIRPKVRDQEGRMNYYWTLVEPGDKITFEATGNLVVPRYAFAMERNAGSGIIISGTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVVLENERTLEYHDSNVKNLYEKVRNQLKNNAKEIGNGCFEFYHKCDNTCMESVKNGIYDYPKYSEEAKLNREEIDGVKLESTRIYQILAIYSTVASSLVQVVSLGAISFWMCFNGSLQCRICI

SEQ ID NO: 12465 - protein, 566 aa, Artificial Sequence
  hemagglutinin__InfluenzaA__AID70447
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPQAGAKGFYKNLLWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTSVGKEFNHLEKRMENLNKKVDDGFLDIWTYNAELLVVLENERTLEYHDSNVKNLYEKVRNQLKNNAKEIGNGCFEFYHKCDNTCMESVKNGIYDYPKYSEEAKLNREEIDGVKLESTRIYQILAIYSTVASSLVLVVSLGAISFWMCFNGSLQCRICI

SEQ ID NO: 12466 - protein, 566 aa, Artificial Sequence
  hemagglutinin__InfluenzaA__AID70448
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFTMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVVLENERTLEYQDSNVKNLYEKVRNQLKNNAKEIGNGCLEFYHKFDNTCMESVKNGTYDYPKYSEEAKLNREKIDGVKLESTRIYQILAIYSTVASSLVLVVSLGTISFWMCFNGSLQCRICI

SEQ ID NO: 12467 - protein, 566 aa, Artificial Sequence
  hemagglutinin__InfluenzaA__AID70449
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVVLENERTLEYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCFNGSLQCRICV

SEQ ID NO: 12468 - protein, 566 aa, Artificial Sequence
  hemagglutinin__InfluenzaA__AID70450
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTSKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVVLENERTLEYHDSNVKNLYEKVRNQLKNNAKEIGNGCFEFYHKFDNTCMESVKNGTYDYPKYSEEAKLNREKIDGVKLESTRIYQILAIYSTVASSLVQVVSLGAISFWMCFNGSLQCRICI

SEQ ID NO: 12469 - protein, 566 aa, Artificial Sequence
  hemagglutinin__InfluenzaA__AID70451
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVVLENERTLEYHDSNVKNLYEKVRNQLKNNAKEIGNGCFEFYHKFDNTCMESVKNGTYDYPKYSEEAKLNREEIDGVKLESTRIYQILAIYSTVASSLVLVVSLGAISFWMCFNGSLQCRICI

SEQ ID NO: 12470 - protein, 566 aa, Artificial Sequence
  hemagglutinin__InfluenzaA__AID70452
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLGSVSSFKRFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVVLENERTLEYHDSNVKNLYEKVRNQLKNNAKEIGNGCFEFYHKCDNTCMESVKNGIYDYPKYSEEAKLNREKIDGVKLESTRIYQILAIYSTVASSLVLVVSLGAISFWMRFNGSLQCSICI

SEQ ID NO: 12471 - protein, 566 aa, Artificial Sequence
  hemagglutinin__InfluenzaA__AID70453
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVQDCNTTCQTPKGAINTSLPFQNIHPITIGKCPKYVKSTKLRLVTGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVVLENERTLEYHDSNLKNLYEKVRNQLKNNAKEIGNGCFEFYHKFDNTCMESVKNGTYDYPKYSEEAKLNREEIDGVKLESTRIYQILAIYSTVASSLVQVVSLGAISFWMRFNGSLHCRICI

SEQ ID NO: 12472 - protein, 566 aa, Artificial Sequence
  hemagglutinin__InfluenzaA__AID70454
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKMRLATGLRNVPCIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVVLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12473 - protein, 566 aa, Artificial Sequence
  hemagglutinin__InfluenzaA__AID70455
MKAILVVLLYTFATANADTLCIGYHANNSTDTVDTVLEKNVTVTHSVNLLEDKHNGKLCKLGGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKISKSYINDKGKEVLVLWGIHHPSTTADQQSLYQNADTYIFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIKKMNTQFTAVGKEFNHLEKRIENLNKKVDDGFLDIWTYNAELLVVLENERTLEYHDSNVKNLYEKVRNQLKNNAKEIGNGCFEFYHKFDNTCMESVKNGTYDYPKYSEEAKLNREEIDGVKLESTRIYQILAIYSTVASSLVLVVSLGAISFWMCFNGSLQCRICI

SEQ ID NO: 12474 - protein, 566 aa, Artificial Sequence
  hemagglutinin__InfluenzaA__AID70456
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVVKEFNHLEKRIENLNKKVDDGFLDIWTYNAELLVVLENERTLEYHDSNLKNLYEKVRNQLKNNAKEIGNGCFEFYHKFDNTCMESVKNGTYDYPKYSEEAKLNREEIDGVKLESTRIYQILAIYSTVASSLVQVVSLGAISFWMCFNGSLQCRICI

SEQ ID NO: 12475 - protein, 566 aa, Artificial Sequence
  hemagglutinin__InfluenzaA__AID70457
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVVLENERTLEYHDSNVKNLYEKVRNQLKNNAKEIGNGCFEFYHKFDNTCMESVKNGTYDYPKYSEEAKLNREKIDGVKLESTRIYQILAIYSTVASSLVQVVSLGAISFWKCFNGSLQCRICS

SEQ ID NO: 12476 - protein, 566 aa, Artificial Sequence
  hemagglutinin__InfluenzaA__AID70458
MKTIIALSYILCLVFAQKFPGNDNSMATLCLGHHAVPNGTMVKTITNDQIEVTNATELVQSSSTGGICNSPHQILDGGNCTLIDALLGDPQCDGFQNKKWDLFVERSKAYSNCYPYDVPDYASLRSIVASSGTLEFNNESFNWTGVTQNGKSASCKRGSDNSFFSRLNWLTHLNYKYPALKVTMPNNEKFDKLYIWGVHHPGTYNDQISLYAQASGIITVSTKRNQQTVIPNIGSRPRVRDIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGMGQAADLKSTQAAINQINGKLNRLIGKTIEKFHQIEKEFSEVEGRIQDLEKYVEDTKIDLWSYNAELLVALENQHTIDLTDSEMDKLFERTKKQMRENAEDMGNGCFKIYHKCDNACIGSIRNGIYDRDIYRDEALSNRFQIKGVELKAGYKDWILWISFAISCFLLCVVLLGFIMWACQKGNLRCNICI

SEQ ID NO: 12477 - protein, 566 aa, Artificial Sequence
  hemagglutinin__InfluenzaA__AID70459
MKTIIALSYILCLVFAQKVPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLAPGMRNVPEKQTRGIFGAIAGFIENGWEGMVDGWYGFRHQNSEGRGQAADLKSTQAAIDQINGKLNRLIGKTIEKFHQIENEFSEVEGRIQDLEKYVEDTKIDLWSYIAELLVALENQHTIDLTDSEMNKLFEKTKKQLRENAEDMGNGCFKIYHKCDNACIGSIRNGIYDHDVYRDEALNNRFQIKGVELKSGYKDWILWISFAISCFLLCVALLGFIMWACQKGNIRCNICI

SEQ ID NO: 12478 - protein, 566 aa, Artificial Sequence
  hemagglutinin__InfluenzaA__AID70460
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTIEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGIYDHDVYRDEALNNRFQIKGVELKSGYKDWILWISFAISCFLLCVALLGFIMWACQKGNIRCNICI

SEQ ID NO: 12479 - protein, 566 aa, Artificial Sequence
  hemagglutinin__InfluenzaA__AID70461
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTIEKFHQIEKEFSEVEGRIQDLEKYIEDTKIDLWSYNAELLVALENQHTIDLTDSEMNKLFEKTKKQLRENAEDMGNGCFKIYHKCDNACIGSIRNGIYDHDVYRDEALNNRFQIKGVELKSGYKDWILWISFAISCFLLCVALLGFIMWACQKGNIRCITCI

SEQ ID NO: 12480 - protein, 566 aa, Artificial Sequence
  hemagglutinin__InfluenzaA__AID70463
MKTIIALSYILCLVFAQKIPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTIEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGIYDHDVYRDEALNNRFQIKGVELKSGYKDWILWISFAISCFLLCVALLGFIMWACQKGNIRCNICI

SEQ ID NO: 12481 - protein, 566 aa, Artificial Sequence
  hemagglutinin__InfluenzaA__AID70464
MKTIIALSYILCLVFAQKLPGDDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTIEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12482 - protein, 566 aa, Artificial Sequence
  hemagglutinin__InfluenzaA__AID70465
MKTIIALSYILCLVFAQKLPGDDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTIEKFHQIEKEFSEVEGRIQDLEKYVEDTKIDLWSYNAELLVALENHHAIDLTDSEMNKLFEKTKKQMRENAEDMGNGCFKIYLKCDNACIGSIRNGIYDHDVYRDEALNNRFQIKGVELKSGYKDWILWISFTESCFLLCVALLGFIMWACQKGNIRCNICI

SEQ ID NO: 12483 - protein, 566 aa, Artificial Sequence
  hemagglutinin__InfluenzaA__AID70466
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTIEKFHQIENEFSEVEGRIQDLEKYVEDTKIDLWSYIGELLVALENQHTIDLTDSEMNKLFEKTKKQLRENAEDMGNGCFKIYHKCDNACIGSIRNGIYDHDVYRDEALNNRFQIKGVELKSGYKDWILWISFAISCFLLCVALLGFIMWACQKGNIRCNICI

SEQ ID NO: 12484 - protein, 566 aa, Artificial Sequence
  hemagglutinin__InfluenzaA__AID70467
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNCEGRGQAADLKSTQAAIDQINGKLNRLIGKTIEKFHQIENEFSEVEGRIQGLEKYVEDTKIDLWSYIAELIVALENQHTIDLTDSEMNKLFEKTKKQMRENAEDMGNGCFKIYHKCDNACIGSIRNGIYDHDVYRDEALNNRFQIKGVELKSGYKDWILWISFAISCFLLCVALLGFIMWACQKGNIRCNICI

SEQ ID NO: 12485 - protein, 566 aa, Artificial Sequence
  hemagglutinin__InfluenzaA__AID70468
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNCEGRGQAADLKSTQAAIDQINGKLNRLMGKSIEKFHQIENEFSEVEGRIQGLEKYVEDTKIDLWSYNGELIVALENQHAIDLTDSEMNKLFEKTKKQMRENAEDMGNGCFKIYLKCDNACIGSIRNGIYDHDVYRDEALNNRFQIKGVELKSGYKDWILWISFTISCFLLCVALLGFIMWARQKGNIRCNICI

SEQ ID NO: 12486 - protein, 566 aa, Artificial Sequence
  hemagglutinin__InfluenzaA__AID70469
MKTIIALSYILCLVFAQKVPGNENSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNCEGRGQAADLKSTQAAIDQINGKLNRLIGKTIEKFHQIEKEFSEVEGRIQGLEKYVEDTKIDLWSYNAELLVALENQHTIDLTDSEMNKLFEKTKKQMRENAEDMGNGCFKIYHKCDNACIGSIRNGIYDHDVYRDEALNNRFQIKGVELKSGYKDWILWISFTISCFLLCVALLGFIMWACQKGNIRCNICI

SEQ ID NO: 12487 - protein, 566 aa, Artificial Sequence
  hemagglutinin__InfluenzaA__AID70470
MKTIIALSYILCLVFAQKVPGNENSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNCEGRGQAADLKSTQAAIDQINGKLNRLIGKTIEKFHQIEKEFSEVEGRIQGLEKYVEDTKIDLWSYNGELLVALENHHTIDLTDSEMNKLFEKTKKQMRENAEDMGNGCFKIYHKCDNACIGSIRNGIYDHDVYRDEALNNRFQIKGVELKSGYKDWILWISFTISCFLLCVALLGFIMWACQKGNIRCNICI

SEQ ID NO: 12488 - protein, 566 aa, Artificial Sequence
  hemagglutinin__InfluenzaA__AID70471
MKTIIALSYILCLVFTQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTIEKFHQIENEFSEVEGRIQDLEKYVEDTKIDLWSYNAELIVALENHHTIDLTDSEMNKLFEKTKKQMRENAEDMGNGCFKIYHKCDNACIGSIRNGIYDHDVYRDEALNNRFQIKGVELKSGYKDWILWISFAISCFLICVALLGFIMWACQKGNLRCNICI

SEQ ID NO: 12489 - protein, 566 aa, Artificial Sequence
  hemagglutinin__InfluenzaA__AID70472
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTIEKFHQIEKEFSEVEGRIQDLEKYVEDTKIDLWSYNAELLVALENHHTIDLTDSEMNKLFEKTKKQMRENAEDMGNGCFKIYHKCDNACIGSIRNGIYDHDVYRDEALNNRFQIKGVELKSGYKDWILWISFAISCFLLCVALLGFIMWACQKGNIRCNICI

SEQ ID NO: 12490 - protein, 566 aa, Artificial Sequence
  hemagglutinin__InfluenzaA__AID70473
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNCEGRGQAADLKSTQAAIDQINGKLNRLIGKTIEKFHQIEKEFSEVEGRIQGLEKYVEDTKIDLWSYNAELLVALENQHTIDLTDSEMNKLFEKTKKQMRENAEDMGNGCFKIYHKCDNACIGSIRNGIYDHDVYRDEALNNRFQIKGVELKSGYKDWILWISFAISCFLLCVALLGFIMWACQKGNIRCNICI

SEQ ID NO: 12491 - protein, 566 aa, Artificial Sequence
  hemagglutinin__InfluenzaA__AID70474
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENVWEGMVDGWFGFRHQICEGRGQAAGLESTQAAIDQINGKMNRLMGKTIGKFHQIVNEFSEVEGRIQDLEKYVEDTKIDLWSYIGELLVALENHHAIDLTDSEMNKLFEKTKKQMRENAEDMGNGCFKIYHKCDNACIGSIRNGIYDRDVYRDEALNNRFHIKGVELKSGYKDWIIWISSTESCFLLCVALLGFIMWACQKGNIRSNICI

SEQ ID NO: 12492 - protein, 566 aa, Artificial Sequence
  hemagglutinin__InfluenzaA__AID70475
MKTIIALSYMLCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENVWEGMVDGWYGFRHQNCEGRGQAADLKSAQAAIDPINGKLNRLMGKTIGKFHQIEKEFSEVEGRIQDLEKYVEDTKIDLWSYNGELLVALENQHAIDLTDSEMNKVFEKTKKQLRENAEDMGNGCFKIYHKCDNACIGSIRNGIYDHDVYRNEALNNRFQIKGVELKSGYKDWILWISFAISCFLLSVASLGFIMWAYQKGNIRCNICI

SEQ ID NO: 12493 - protein, 566 aa, Artificial Sequence
  hemagglutinin__InfluenzaA__AID70476
MKTIIALSYILCLVFAQKLPGNENSTATLGLGHHAVPNGTIVKTITNDQIEVTNATELVQSSSTGEICNSPHQILDGENCTLIDALLGDPQCDDFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNNLKLATGMRNVPEKQTRGIFGAIAGFIENGWEGMVDGWYGFRHQNSEGRGQAADLKSTQAAIDQINGKLNRLIGKTIEKFHQIEKEFSEVEGRIQGREKYVEDTKIDLWSYIGEFIVALENQHTIDLTDSEMNKLFEKTKKQMRENAEDMGNGCFKIYHKCDNACIGSIRNGIYDHDVYRDEALNNRFQIKGVELKSGYKDWILWISFAISCFLLCVALLGFIMWACQKGNIRCNICI

SEQ ID NO: 12494 - protein, 566 aa, Artificial Sequence
  hemagglutinin__InfluenzaA__AID70477
MKTIIALSYILCLVFAQKLPGNDSSTGTLCLGHHAVPNGTIVKTITNDQIEVTNATELVQSSSTGEICNRPHQILDGENCTLIDALLGDPQCDGFQNKKWDLFVERSKAHSNCYPYDVPDYASLRSLVASSGTLEFNNESFNWTGVTQNGTSSACIRRSNNSFFSILNWLTHLNFKYPALNVTMPNNEQFDKLYIWGVHHPGTDKDQIFLYAQASGRITVSTKKSQQAVIPNIGSRPRVRNIPSRVSIYWTIVKPGEILLINSTGNLIAPRGYFKIRSGKSSIMRSDAPIGKCYSACITPNGSIPNDKPFQNVNRITYGACPRYVKQHPLKLATGMRNVPEKQTRGIFGAIAGFIENGWEGMVDGWYGFRHQICEGRGQAADLKSTQAAIDQINGKLNRLIGKTIEKFHQIEKEFSEVEWRIQGLEKYVEDTKVDLWSYNGELIVALENHHTIDLTDSEMNKLFEKTKKQMRENAEDMGNGCFKIYLKCDNACIGSIRNGIYDHDVYRDEALNNRFQIKGVELKSGYKDWILWISFTESCFLLSVALLGFIMWACQKGNIRCNICI

SEQ ID NO: 12495 - protein, 566 aa, Artificial Sequence
  hemagglutinin__InfluenzaA__AID70478
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKKSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNCEGRGQAADLESTQAAIDQINGKMNRLMGKTIEKFHQIEKEFSEVEGRIQGREKYVEDTKIDLWSYNGELLVDLENQHTIDLTDSEMNKVFEKTKKQMRENAEDMGNGCFKIYHKCDNACIGSIRNGIYDHDVYRDEALNNRFQIKGVELKSGYKDWIQWISFTISCFLLCVSLLGFIMWACQKGNIRCNICI

SEQ ID NO: 12496 - protein, 566 aa, Artificial Sequence; identical to SEQ ID NO: 10040
  hemagglutinin__InfluenzaA__AID70632

SEQ ID NO: 12497 - protein, 560 aa, Artificial Sequence
  hemagglutinin__InfluenzaA__AID70634
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRIIEKTNQQFELIDNEFNEVEKQISNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 12498 - protein, 566 aa, Artificial Sequence
  hemagglutinin__InfluenzaA__AIF72902
MKTIIALSYILCLVFAQKLPGNDNSTATLCLGHHAVPNGTIVKTITNDQIEVTNATELVQSSSAGEICDSPHQILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12499 - protein, 566 aa, Artificial Sequence
  hemagglutinin__InfluenzaA__AIF72903
MKTIIALSYILCLVFAQELPGNDNSTATLCLGHHAVPNGTIVKTITNDQIEVTNATELVQSSSAGEICDSPHQILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWVLWISFAISCFLLCVALLGFIMWACQKGNIRCNICI

SEQ ID NO: 12500 - protein, 566 aa, Artificial Sequence
  hemagglutinin__InfluenzaA__AIF72904
MKTIIALSYILCLVFAQELPGNDNSTATLCLGHHAVPNGTIVKTITNDQIEVTNATELVQSSSAGEICDSPHQILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWVLWISFAISCFLLCVALLGFIMWACQKGNIRCNICI

SEQ ID NO: 12501 - protein, 566 aa, Artificial Sequence
  hemagglutinin__InfluenzaA__AIF72905
MKTIIALSYILCLVFAQKLPGNDNSTATLCLGHHAVPNGTIVKTITNDQIEVTNATELVQSSSAGEICDSPHQILDGENCTLIDALLGDPQCDGFQNKKWDLFVERSRAYSNCYPYDVPDYASLRSLVASSGTLEFKNESFNWTGVTQNGTSSACIRRSNNSFFSRLNWLTHSNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12502 - protein, 566 aa, Artificial Sequence; identical to SEQ ID NO: 3411
  hemagglutinin__InfluenzaA__AIF72906

SEQ ID NO: 12503 - protein, 566 aa, Artificial Sequence; identical to SEQ ID NO: 3411
  hemagglutinin__InfluenzaA__AIF72907

SEQ ID NO: 12504 - protein, 566 aa, Artificial Sequence; identical to SEQ ID NO: 3411
  hemagglutinin__InfluenzaA__AIF72908

SEQ ID NO: 12505 - protein, 566 aa, Artificial Sequence
  hemagglutinin__InfluenzaA__AIF72909
MKTIIALSYILCLVFAQKLPGNDNSTATLCLGHHAVPNGTIVKTITNDQIEVTNATELVQSSSAGEICDGPHQILDGENCTLIDALLGDPQCDGFQNKKWDLFVERSRAYSNCYPYDVPDYASLRSLVASSGTLEFNNESFNWTGTTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12506 - protein, 566 aa, Artificial Sequence; identical to SEQ ID NO: 3411
  hemagglutinin__InfluenzaA__AIF72910

SEQ ID NO: 12507 - protein, 566 aa, Artificial Sequence; identical to SEQ ID NO: 3411
  hemagglutinin__InfluenzaA__AIF72911

SEQ ID NO: 12508 - protein, 566 aa, Artificial Sequence; identical to SEQ ID NO: 12498
  hemagglutinin__InfluenzaA__AIF72912

SEQ ID NO: 12509 - protein, 566 aa, Artificial Sequence; identical to SEQ ID NO: 3411
  hemagglutinin__InfluenzaA__AIF72913

SEQ ID NO: 12510 - protein, 566 aa, Artificial Sequence
  hemagglutinin__InfluenzaA__AIF72914
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRGGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIHDLEKYVEDTLFDLWVYNSELLVALQNQHTIDLPDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12511 - protein, 566 aa, Artificial Sequence
  hemagglutinin__InfluenzaA__AIF72915
MKTIIALSYILCLVFAQKLPGNDNSTATLCLGHHAVPNGTIVKTITNDQIEVTNATELVQSSSTGEICDSPLQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12512 - protein, 566 aa, Artificial Sequence; identical to SEQ ID NO: 3411
  hemagglutinin__InfluenzaA__AIF72916

SEQ ID NO: 12513 - protein, 566 aa, Artificial Sequence
  hemagglutinin__InfluenzaA__AIF72917
MKTIIALSYILCLVFAQKLPRNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFKNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 12514 - protein, 560 aa, Artificial Sequence
  hemagglutinin__InfluenzaA__AIG44693
METASLITILLVVTVSNADKICIGYQSTNSTETVDTLTENNVPVTHAKELLHTEHNGMLCATSLGQPLILDTCTIEGLIYGNPSCDLLLGGREWSYIVERPSAVNGLCYPGNVENLEELRSLFSSARSYQRIQIFPDTIWNVSYSGTSKACSDSFYRSMRWLTQKDNAYPIQDAQYTNNQEKNILFMWGINHPPTDTAQTNLYTRTDTTTSVATEEINRTFKPLIGPRPLVHGLMGRINYYWSVLKPGQTLRIKSNGNLIAPWYGHILSGKSHGRILKTDLKRGNCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLEKQKIEGVKLESEGTYKILTIYSTVASSLVIAMGFAAFLFWAMSNGSCRCNICI

SEQ ID NO: 12515 - protein, 566 aa, Artificial Sequence; identical to SEQ ID NO: 6982
  hemagglutinin__InfluenzaA__AIJ10728

SEQ ID NO: 12516 - protein, 566 aa, Artificial Sequence
  hemagglutinin__InfluenzaA__AIJ10729
MKTIIALSYILCLVFAQKLPGHDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTKGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12517 - protein, 566 aa, Artificial Sequence; identical to SEQ ID NO: 6982
  hemagglutinin__InfluenzaA__AIJ10730

SEQ ID NO: 12518 - protein, 566 aa, Artificial Sequence; identical to SEQ ID NO: 6982
  hemagglutinin__InfluenzaA__AIJ10731

SEQ ID NO: 12519 - protein, 566 aa, Artificial Sequence
  hemagglutinin__InfluenzaA__AIJ10732
MKTIIALSYILCLVFAQELPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFRYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12520 - protein, 566 aa, Artificial Sequence
  hemagglutinin__InfluenzaA__AIJ10733
MKTIIALSYILCLVFAQELPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFRYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCKSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12521 - protein, 566 aa, Artificial Sequence
  hemagglutinin__InfluenzaA__AIJ10734
MKTIIALSYILCLVFAQKLPENDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSTCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12522 - protein, 566 aa, Artificial Sequence
  hemagglutinin__InfluenzaA__AIJ10735
MKTIIALSYILCLIFAQKLPENDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSTCITPNGSIPNDKPFQNVNRITYGACPRYVKQNTLKLATGMRNVPEKQTRGIFGAIAGFIENGWEGMVDGWYGFRHQNSEGKGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12523 - protein, 566 aa, Artificial Sequence
  hemagglutinin__InfluenzaA__AIJ10736
MKTIIALSYILCLVFAQKLPGNDNSTATLCLGHHAVPNGTIVKTITNDRIEVTNATELVQNSTIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12524 - protein, 566 aa, Artificial Sequence
  hemagglutinin__InfluenzaA__AIJ10737
MKTIIALSYILCLVVAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12525 - protein, 566 aa, Artificial Sequence
  hemagglutinin__InfluenzaA__AIJ10738
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEHFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12526 - protein, 566 aa, Artificial Sequence; identical to SEQ ID NO: 9453
  hemagglutinin__InfluenzaA__AIJ10740

SEQ ID NO: 12527 - protein, 566 aa, Artificial Sequence; identical to SEQ ID NO: 9453
  hemagglutinin__InfluenzaA__AIJ10741

SEQ ID NO: 12528 - protein, 566 aa, Artificial Sequence
  hemagglutinin__InfluenzaA__AIJ10742
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVATKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12529 - protein, 566 aa, Artificial Sequence
  hemagglutinin__InfluenzaA__AIJ10743
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDIKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12530 - protein, 566 aa, Artificial Sequence
  hemagglutinin__InfluenzaA__AIJ10744
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQRTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12531 - protein, 566 aa, Artificial Sequence; identical to SEQ ID NO: 9994
  hemagglutinin__InfluenzaA__AIJ10745

SEQ ID NO: 12532 - protein, 566 aa, Artificial Sequence
  hemagglutinin__InfluenzaA__AIJ10747
MKTIIALSYILCLVFAQKLPGNDNSTATLCLGHHAVPNGTIVKTITNDRIEVTNATELVQNSSIGEICDSPHQILDGENCTLIDALLGDPQCDDFQNKKWDLFVERSKAYSNCYPYDVPDYASLRSLVASSGTLEFNNENFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12533 - protein, 566 aa, Artificial Sequence; identical to SEQ ID NO: 12532
  hemagglutinin__InfluenzaA__AIJ10748

SEQ ID NO: 12534 - protein, 566 aa, Artificial Sequence
  hemagglutinin__InfluenzaA__AIJ10750
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIIRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12535 - protein, 566 aa, Artificial Sequence
  hemagglutinin__InfluenzaA__AIJ10752
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAMSCFLLCVALLGFIMWACQKGNIRCNICI

SEQ ID NO: 12536 - protein, 566 aa, Artificial Sequence
  hemagglutinin__InfluenzaA__AIJ10753
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12537 - protein, 566 aa, Artificial Sequence; identical to SEQ ID NO: 9994
  hemagglutinin__InfluenzaA__AIJ10754

SEQ ID NO: 12538 - protein, 566 aa, Artificial Sequence
  hemagglutinin__InfluenzaA__AIJ10755
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQSAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12539 - protein, 566 aa, Artificial Sequence; identical to SEQ ID NO: 9994
  hemagglutinin__InfluenzaA__AIJ10756

SEQ ID NO: 12540 - protein, 566 aa, Artificial Sequence
  hemagglutinin__InfluenzaA__AIJ10757
MKTIIALSYILCLVIAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12541 - protein, 566 aa, Artificial Sequence
  hemagglutinin__InfluenzaA__AIJ10758
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12542 - protein, 566 aa, Artificial Sequence; identical to SEQ ID NO: 9994
  hemagglutinin__InfluenzaA__AIJ10759

SEQ ID NO: 12543 - protein, 566 aa, Artificial Sequence
  hemagglutinin__InfluenzaA__AIJ10760
MKTIIALSYILCLVIAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12544 - protein, 566 aa, Artificial Sequence
  hemagglutinin__InfluenzaA__AIJ10761
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRNEALNKRFQIKGVELKSGYKDWILWISFAISCFLLCVVLLGFIMWACQKGNIRCNICI

SEQ ID NO: 12545 - protein, 566 aa, Artificial Sequence; identical to SEQ ID NO: 11892
  hemagglutinin__InfluenzaA__AIJ10762

SEQ ID NO: 12546 - protein, 566 aa, Artificial Sequence; identical to SEQ ID NO: 11892
  hemagglutinin__InfluenzaA__AIJ10763

SEQ ID NO: 12547 - protein, 566 aa, Artificial Sequence; identical to SEQ ID NO: 11892
  hemagglutinin__InfluenzaA__AIJ10764

SEQ ID NO: 12548 - protein, 566 aa, Artificial Sequence; identical to SEQ ID NO: 11892
  hemagglutinin__InfluenzaA__AIJ10765

SEQ ID NO: 12549 - protein, 566 aa, Artificial Sequence; identical to SEQ ID NO: 11892
  hemagglutinin__InfluenzaA__AIJ10766

SEQ ID NO: 12550 - protein, 566 aa, Artificial Sequence; identical to SEQ ID NO: 11892
  hemagglutinin__InfluenzaA__AIJ10767

SEQ ID NO: 12551 - protein, 566 aa, Artificial Sequence
  hemagglutinin__InfluenzaA__AIJ10768
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNIPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12552 - protein, 566 aa, Artificial Sequence
  hemagglutinin__InfluenzaA__AIJ10769
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIQSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12553 - protein, 566 aa, Artificial Sequence; identical to SEQ ID NO: 11892
  hemagglutinin__InfluenzaA__AIJ10770

SEQ ID NO: 12554 - protein, 566 aa, Artificial Sequence; identical to SEQ ID NO: 11892
  hemagglutinin__InfluenzaA__AIJ10771

SEQ ID NO: 12555 - protein, 566 aa, Artificial Sequence; identical to SEQ ID NO: 11892
  hemagglutinin__InfluenzaA__AIJ10772

SEQ ID NO: 12556 - protein, 566 aa, Artificial Sequence; identical to SEQ ID NO: 11892
  hemagglutinin__InfluenzaA__AIJ10773

SEQ ID NO: 12557 - protein, 566 aa, Artificial Sequence
  hemagglutinin__InfluenzaA__AIJ10774
MKTIIALSYILCLVFAQKLPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQSAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12558 - protein, 566 aa, Artificial Sequence
  hemagglutinin__InfluenzaA__AIJ10776
MKTIIALSCILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMSKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12559 - protein, 566 aa, Artificial Sequence; identical to SEQ ID NO: 11892
  hemagglutinin__InfluenzaA__AIJ10777

SEQ ID NO: 12560 - protein, 566 aa, Artificial Sequence; identical to SEQ ID NO: 11892
  hemagglutinin__InfluenzaA__AIJ10778

SEQ ID NO: 12561 - protein, 566 aa, Artificial Sequence
  hemagglutinin__InfluenzaA__AIJ10780
MKTIIALSYILCLVFAQKLPGNDNSTATLCLGHHAVPNGTIVKTITNDRIEVTNATELVQNSSIGEICDSPHQILDGENCTLIDALLGDPQCDSFQNKKWDLFVERSKAYSNCYPYDVPDYASLRSLVASSGTLEFNNESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDIEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12562 - protein, 566 aa, Artificial Sequence; identical to SEQ ID NO: 11892
  hemagglutinin__InfluenzaA__AIJ10781

SEQ ID NO: 12563 - protein, 566 aa, Artificial Sequence; identical to SEQ ID NO: 11892
  hemagglutinin__InfluenzaA__AIJ10782

SEQ ID NO: 12564 - protein, 566 aa, Artificial Sequence
  hemagglutinin__InfluenzaA__AIJ10783
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWVGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12565 - protein, 566 aa, Artificial Sequence; identical to SEQ ID NO: 12564
  hemagglutinin__InfluenzaA__AIJ10784

SEQ ID NO: 12566 - protein, 566 aa, Artificial Sequence
  hemagglutinin__InfluenzaA__AIJ10785
MKTIIALSYILCLVFAQKLPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQSAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12567 - protein, 566 aa, Artificial Sequence; identical to SEQ ID NO: 12564
  hemagglutinin__InfluenzaA__AIJ10786

SEQ ID NO: 12568 - protein, 566 aa, Artificial Sequence
  hemagglutinin__InfluenzaA__AIJ10787
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWVGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFRIKGVELKSGYKDWILWISFAISCFLLCVALLGFIMWACQKGNIRCNICI

SEQ ID NO: 12569 - protein, 566 aa, Artificial Sequence; identical to SEQ ID NO: 12566
  hemagglutinin__InfluenzaA__AIJ10788

SEQ ID NO: 12570 - protein, 566 aa, Artificial Sequence; identical to SEQ ID NO: 12566
  hemagglutinin__InfluenzaA__AIJ10789

SEQ ID NO: 12571 - protein, 566 aa, Artificial Sequence; identical to SEQ ID NO: 12564
  hemagglutinin__InfluenzaA__AIJ10790

SEQ ID NO: 12572 - protein, 566 aa, Artificial Sequence; identical to SEQ ID NO: 11892
  hemagglutinin__InfluenzaA__AIJ10791

SEQ ID NO: 12573 - protein, 566 aa, Artificial Sequence
  hemagglutinin__InfluenzaA__AIJ10792
MKTIIALSYILCLVFAQKLPGDDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12574 - protein, 566 aa, Artificial Sequence; identical to SEQ ID NO: 9883
  hemagglutinin__InfluenzaA__AIJ29347

SEQ ID NO: 12575 - protein, 566 aa, Artificial Sequence
  hemagglutinin__InfluenzaA__AIJ29349
MKTIIALSYILCLVFAQKFPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12576 - protein, 566 aa, Artificial Sequence
  hemagglutinin__InfluenzaA__AIJ29351
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCLLLCVALLGFIMWACQKGNIRCNICI

SEQ ID NO: 12577 - protein, 566 aa, Artificial Sequence; identical to SEQ ID NO: 9480
  hemagglutinin__InfluenzaA__AIJ29353

SEQ ID NO: 12578 - protein, 566 aa, Artificial Sequence
  hemagglutinin__InfluenzaA__AIJ29355
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRSRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 12579 - protein, 566 aa, Artificial Sequence; identical to SEQ ID NO: 9074
  hemagglutinin__InfluenzaA__AIJ29357

SEQ ID NO: 12580 - protein, 566 aa, Artificial Sequence
  hemagglutinin__InfluenzaA__AIJ29359
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEAINNRFQIKGVELKSGYKDWILWISFAISCFLLCVALLGFIMWACQKGNIRCNICI

SEQ ID NO: 12581 - protein, 566 aa, Artificial Sequence
  hemagglutinin__InfluenzaA__AIJ29361
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYVSLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12582 - protein, 566 aa, Artificial Sequence; identical to SEQ ID NO: 10040
  hemagglutinin__InfluenzaA__AIL93623

SEQ ID NO: 12583 - protein, 566 aa, Artificial Sequence
  hemagglutinin__InfluenzaA__AIL93634
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCNNTCMESVKNGTYDYPKYSEEAKLNREKIDGVKLESTRIYQILAIYSTVASSLVLVVSLGAISFWMCSNGSLQCRICI

SEQ ID NO: 12584 - protein, 566 aa, Artificial Sequence
  hemagglutinin__InfluenzaA__AIL93645
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFRYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12585 - protein, 566 aa, Artificial Sequence; identical to SEQ ID NO: 9994
  hemagglutinin__InfluenzaA__AIL93657

SEQ ID NO: 12586 - protein, 566 aa, Artificial Sequence; identical to SEQ ID NO: 9994
  hemagglutinin__InfluenzaA__AIL93669

SEQ ID NO: 12587 - protein, 566 aa, Artificial Sequence
  hemagglutinin__InfluenzaA__AIL93681
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERSAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12588 - protein, 566 aa, Artificial Sequence; identical to SEQ ID NO: 12584
  hemagglutinin__InfluenzaA__AIL93692

SEQ ID NO: 12589 - protein, 566 aa, Artificial Sequence; identical to SEQ ID NO: 12584
  hemagglutinin__InfluenzaA__AIL93716

SEQ ID NO: 12590 - protein, 566 aa, Artificial Sequence; identical to SEQ ID NO: 9994
  hemagglutinin__InfluenzaA__AIL93728

SEQ ID NO: 12591 - protein, 566 aa, Artificial Sequence; identical to SEQ ID NO: 9994
  hemagglutinin__InfluenzaA__AIL93740

SEQ ID NO: 12592 - protein, 566 aa, Artificial Sequence
  hemagglutinin__InfluenzaA__AIL93752
MKTIIALSYILCLVFAQKLPGNDNSTATLCLGHHAVPNGTIVKTITNDRIEVTNATELVQNSSIGEICDRPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKKSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12593 - protein, 566 aa, Artificial Sequence
  hemagglutinin__InfluenzaA__AIL93764
MKTIIALSYILCLVFTQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNETYDHDVYRDEALNNRFQIKGVELKSGYKDWILWISFAISCFLLCVALLGFIMWACQKGNIRCNICI

SEQ ID NO: 12594 - protein, 566 aa, Artificial Sequence; identical to SEQ ID NO: 9994
  hemagglutinin__InfluenzaA__AIL93776

SEQ ID NO: 12595 - protein, 566 aa, Artificial Sequence; identical to SEQ ID NO: 9994
  hemagglutinin__InfluenzaA__AIL93788

SEQ ID NO: 12596 - protein, 566 aa, Artificial Sequence; identical to SEQ ID NO: 9994
  hemagglutinin__InfluenzaA__AIL93812

SEQ ID NO: 12597 - protein, 566 aa, Artificial Sequence; identical to SEQ ID NO: 9994
  hemagglutinin__InfluenzaA__AIL93824

SEQ ID NO: 12598 - protein, 566 aa, Artificial Sequence; identical to SEQ ID NO: 12587
  hemagglutinin__InfluenzaA__AIL93836

SEQ ID NO: 12599 - protein, 566 aa, Artificial Sequence
  hemagglutinin__InfluenzaA__AIL93847
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERSAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAICFWMCSNGSLQCRICI

SEQ ID NO: 12600 - protein, 566 aa, Artificial Sequence; identical to SEQ ID NO: 12584
  hemagglutinin__InfluenzaA__AIL93858

SEQ ID NO: 12601 - protein, 566 aa, Artificial Sequence; identical to SEQ ID NO: 9994
  hemagglutinin__InfluenzaA__AIL93870

SEQ ID NO: 12602 - protein, 566 aa, Artificial Sequence
  hemagglutinin__InfluenzaA__AIL93882
MKTIIALSYILCLVFAQKPPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12603 - protein, 566 aa, Artificial Sequence; identical to SEQ ID NO: 9994
  hemagglutinin__InfluenzaA__AIL93894

SEQ ID NO: 12604 - protein, 566 aa, Artificial Sequence
  hemagglutinin__InfluenzaA__AIL93906
MKAILVVLLYTFATANADTLCIGYHANNSTDTVDTVLEKNVTVTHSINLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSKYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12605 - protein, 566 aa, Artificial Sequence
  hemagglutinin__InfluenzaA__AIL93917
MKTIIALSYILCLVFAQKLPGNDNSTATLCLGHHAVPNGTIVKTITNDRIEVTNATELVQNSSIGEICDRPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQMRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12606 - protein, 566 aa, Artificial Sequence; identical to SEQ ID NO: 10040
  hemagglutinin__InfluenzaA__AIL93929

SEQ ID NO: 12607 - protein, 566 aa, Artificial Sequence
  hemagglutinin__InfluenzaA__AIL93940
MKAILVVLLYTFATANADTLCIGYHANNSTDTVDTVLEKNVTVTHSVNLLEDKHNGKLCKLRGVSPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12608 - protein, 566 aa, Artificial Sequence; identical to SEQ ID NO: 9994
  hemagglutinin__InfluenzaA__AIL93951

SEQ ID NO: 12609 - protein, 566 aa, Artificial Sequence; identical to SEQ ID NO: 9994
  hemagglutinin__InfluenzaA__AIL93963

SEQ ID NO: 12610 - protein, 566 aa, Artificial Sequence; identical to SEQ ID NO: 9858
  hemagglutinin__InfluenzaA__AIL93975

SEQ ID NO: 12611 - protein, 566 aa, Artificial Sequence; identical to SEQ ID NO: 12587
  hemagglutinin__InfluenzaA__AIL93987

SEQ ID NO: 12612 - protein, 566 aa, Artificial Sequence; identical to SEQ ID NO: 9994
  hemagglutinin__InfluenzaA__AIL93998

SEQ ID NO: 12613 - protein, 566 aa, Artificial Sequence; identical to SEQ ID NO: 12584
  hemagglutinin__InfluenzaA__AIL94010

SEQ ID NO: 12614 - protein, 566 aa, Artificial Sequence; identical to SEQ ID NO: 12584
  hemagglutinin__InfluenzaA__AIL94022

SEQ ID NO: 12615 - protein, 566 aa, Artificial Sequence
  hemagglutinin__InfluenzaA__AIL94046
MKTIIALSYILCLVFAQKLPGNDNSTATLCLGHHAVPNGTIVKTITNDRIEVTNATELVQNSSIGEICDRPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12616 - protein, 566 aa, Artificial Sequence
  hemagglutinin__InfluenzaA__AIL94058
MKAILVVLLYTFAPANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTIERSAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12617 - protein, 566 aa, Artificial Sequence; identical to SEQ ID NO: 12587
  hemagglutinin__InfluenzaA__AIL94069

SEQ ID NO: 12618 - protein, 566 aa, Artificial Sequence; identical to SEQ ID NO: 10040
  hemagglutinin__InfluenzaA__AIL94080

SEQ ID NO: 12619 - protein, 566 aa, Artificial Sequence; identical to SEQ ID NO: 12584
  hemagglutinin__InfluenzaA__AIL94235

SEQ ID NO: 12620 - protein, 566 aa, Artificial Sequence; identical to SEQ ID NO: 10040
  hemagglutinin__InfluenzaA__AIL94247

SEQ ID NO: 12621 - protein, 566 aa, Artificial Sequence
  hemagglutinin__InfluenzaA__AIL94258
MKTIIALSYILCLVFTQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12622 - protein, 566 aa, Artificial Sequence
  hemagglutinin__InfluenzaA__AIL94270
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12623 - protein, 566 aa, Artificial Sequence; identical to SEQ ID NO: 9994
  hemagglutinin__InfluenzaA__AIL94282

SEQ ID NO: 12624 - protein, 566 aa, Artificial Sequence; identical to SEQ ID NO: 9994
  hemagglutinin__InfluenzaA__AIL94294

SEQ ID NO: 12625 - protein, 566 aa, Artificial Sequence
  hemagglutinin__InfluenzaA__AIL94306
MKTITALSYILCLAFAQKPPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12626 - protein, 566 aa, Artificial Sequence
  hemagglutinin__InfluenzaA__AIL94318
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHLNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12627 - protein, 566 aa, Artificial Sequence; identical to SEQ ID NO: 9858
  hemagglutinin__InfluenzaA__AIL94330

SEQ ID NO: 12628 - protein, 566 aa, Artificial Sequence; identical to SEQ ID NO: 10040
  hemagglutinin__InfluenzaA__AIL94354

SEQ ID NO: 12629 - protein, 566 aa, Artificial Sequence; identical to SEQ ID NO: 9994
  hemagglutinin__InfluenzaA__AIL94365

SEQ ID NO: 12630 - protein, 566 aa, Artificial Sequence
  hemagglutinin__InfluenzaA__AIL94377
MKTIIALSYILCLVFAQKLPGNDNSTATLCLGHHAVPNGTIVKTITNDRIEVTNATELVQNSSIGEICDSPHQILDGENCTLIDALLGDPHCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12631 - protein, 566 aa, Artificial Sequence
  hemagglutinin__InfluenzaA__AIL94389
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLILLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12632 - protein, 566 aa, Artificial Sequence; identical to SEQ ID NO: 9994
  hemagglutinin__InfluenzaA__AIL94411

SEQ ID NO: 12633 - protein, 566 aa, Artificial Sequence; identical to SEQ ID NO: 9994
  hemagglutinin__InfluenzaA__AIL94423

SEQ ID NO: 12634 - protein, 566 aa, Artificial Sequence; identical to SEQ ID NO: 12587
  hemagglutinin__InfluenzaA__AIL94435

SEQ ID NO: 12635 - protein, 566 aa, Artificial Sequence; identical to SEQ ID NO: 9994
  hemagglutinin__InfluenzaA__AIL94446

SEQ ID NO: 12636 - protein, 566 aa, Artificial Sequence; identical to SEQ ID NO: 9994
  hemagglutinin__InfluenzaA__AIL94458

SEQ ID NO: 12637 - protein, 566 aa, Artificial Sequence
  hemagglutinin__InfluenzaA__AIL94470
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPAHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12638 - protein, 566 aa, Artificial Sequence
  hemagglutinin__InfluenzaA__AIL94481
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWIIWISFAISCFLLCVALLGFIMWACQKGNIRCNICI

SEQ ID NO: 12639 - protein, 566 aa, Artificial Sequence
  hemagglutinin__InfluenzaA__AIL94493
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMEKNAGSGIIISDTPVHDCNTTCQTPEGAINTSFPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12640 - protein, 566 aa, Artificial Sequence; identical to SEQ ID NO: 12587
  hemagglutinin__InfluenzaA__AIL94504

SEQ ID NO: 12641 - protein, 566 aa, Artificial Sequence; identical to SEQ ID NO: 9994
  hemagglutinin__InfluenzaA__AIL94515

SEQ ID NO: 12642 - protein, 566 aa, Artificial Sequence; identical to SEQ ID NO: 9994
  hemagglutinin__InfluenzaA__AIL94527

SEQ ID NO: 12643 - protein, 566 aa, Artificial Sequence
  hemagglutinin__InfluenzaA__AIL94539
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPAHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEVGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12644 - protein, 566 aa, Artificial Sequence; identical to SEQ ID NO: 12587
  hemagglutinin__InfluenzaA__AIL94550

SEQ ID NO: 12645 - protein, 566 aa, Artificial Sequence
  hemagglutinin__InfluenzaA__AIL94561
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQRGNIRCNICI

SEQ ID NO: 12646 - protein, 566 aa, Artificial Sequence
  hemagglutinin__InfluenzaA__AIL94573
MKAILVVLLYTFATANADTLCIGYHANNSTDTVDTVLEKNVIVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRVYQILAIYSTVASSLVLVVSLGAISFWMCSNGSLQCRICI

SEQ ID NO: 12647 - protein, 566 aa, Artificial Sequence
  hemagglutinin__InfluenzaA__AIL94584
MKAILVVLLYTFATANADTLCIGYHANNSTDTVDTVLEKNITVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGRCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12648 - protein, 566 aa, Artificial Sequence; identical to SEQ ID NO: 12055
  hemagglutinin__InfluenzaA__AIL94595

SEQ ID NO: 12649 - protein, 566 aa, Artificial Sequence; identical to SEQ ID NO: 9994
  hemagglutinin__InfluenzaA__AIL94606

SEQ ID NO: 12650 - protein, 566 aa, Artificial Sequence; identical to SEQ ID NO: 10040
  hemagglutinin__InfluenzaA__AIL94618

SEQ ID NO: 12651 - protein, 566 aa, Artificial Sequence; identical to SEQ ID NO: 12587
  hemagglutinin__InfluenzaA__AIL94629

SEQ ID NO: 12652 - protein, 566 aa, Artificial Sequence; identical to SEQ ID NO: 9994
  hemagglutinin__InfluenzaA__AIL94640

SEQ ID NO: 12653 - protein, 566 aa, Artificial Sequence
  hemagglutinin__InfluenzaA__AIL94652
MKAILVVLLYTFATANADTLCIGYHANNSTDTVDTVLEKNVTVTHSINLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNADAYVFVGTSKYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLDREKIDGVKLESTRIYQILAIYSTVASSLVLVVSLGAISFWMCSNGSLQCRICI

SEQ ID NO: 12654 - protein, 566 aa, Artificial Sequence; identical to SEQ ID NO: 10040
  hemagglutinin__InfluenzaA__AIL94663

SEQ ID NO: 12655 - protein, 566 aa, Artificial Sequence; identical to SEQ ID NO: 10040
  hemagglutinin__InfluenzaA__AIL94674

SEQ ID NO: 12656 - protein, 566 aa, Artificial Sequence; identical to SEQ ID NO: 9994
  hemagglutinin__InfluenzaA__AIL94697

SEQ ID NO: 12657 - protein, 566 aa, Artificial Sequence; identical to SEQ ID NO: 10040
  hemagglutinin__InfluenzaA__AIL94709

SEQ ID NO: 12658 - protein, 566 aa, Artificial Sequence; identical to SEQ ID NO: 10040
  hemagglutinin__InfluenzaA__AIL94720

SEQ ID NO: 12659 - protein, 566 aa, Artificial Sequence; identical to SEQ ID NO: 9994
  hemagglutinin__InfluenzaA__AIL94731

SEQ ID NO: 12660 - protein, 566 aa, Artificial Sequence; identical to SEQ ID NO: 12587
  hemagglutinin__InfluenzaA__AIL94743

SEQ ID NO: 12661 - protein, 566 aa, Artificial Sequence
  hemagglutinin__InfluenzaA__AIL94754
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLILLENERTLDYHDSNVKNLYEKVRNQLKNNAKEIGNGCFEFYHKCDNTCMESAKNGTYDYPKYSEEAKLNREKIDGVKLESTRIYQILAIYSTVASSLVLVVSLGAISFWMCSNGSLQCRICI

SEQ ID NO: 12662 - protein, 566 aa, Artificial Sequence; identical to SEQ ID NO: 12615
  hemagglutinin__InfluenzaA__AIL94765

SEQ ID NO: 12663 - protein, 566 aa, Artificial Sequence; identical to SEQ ID NO: 9994
  hemagglutinin__InfluenzaA__AIL94777

SEQ ID NO: 12664 - protein, 566 aa, Artificial Sequence; identical to SEQ ID NO: 11902
  hemagglutinin__InfluenzaA__AIL94789

SEQ ID NO: 12665 - protein, 566 aa, Artificial Sequence; identical to SEQ ID NO: 10040
  hemagglutinin__InfluenzaA__AIL94800

SEQ ID NO: 12666 - protein, 566 aa, Artificial Sequence
  hemagglutinin__InfluenzaA__AIL94811
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12667 - protein, 566 aa, Artificial Sequence; identical to SEQ ID NO: 9858
  hemagglutinin__InfluenzaA__AIL94823

SEQ ID NO: 12668 - protein, 566 aa, Artificial Sequence
  hemagglutinin__InfluenzaA__AIL94835
MKTIIALSYILCLVFAQKLPGNDNSTATLCLGHHAVPNGTIVKTITNDRIEVTNATELVQNYSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12669 - protein, 566 aa, Artificial Sequence
  hemagglutinin__InfluenzaA__AIL94847
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNDEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12670 - protein, 566 aa, Artificial Sequence; identical to SEQ ID NO: 5533
  hemagglutinin__InfluenzaA__AIL94859

SEQ ID NO: 12671 - protein, 566 aa, Artificial Sequence
  hemagglutinin__InfluenzaA__AIL94871
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGIELKSGYKDWILWISFAISCFLLCVALLGFIMWACQKGNIRCNICI

SEQ ID NO: 12672 - protein, 566 aa, Artificial Sequence; identical to SEQ ID NO: 12080
  hemagglutinin__InfluenzaA__AIL94883

SEQ ID NO: 12673 - protein, 566 aa, Artificial Sequence; identical to SEQ ID NO: 12065
  hemagglutinin__InfluenzaA__AIL94894

SEQ ID NO: 12674 - protein, 566 aa, Artificial Sequence; identical to SEQ ID NO: 9858
  hemagglutinin__InfluenzaA__AIL94906

SEQ ID NO: 12675 - protein, 566 aa, Artificial Sequence; identical to SEQ ID NO: 9994
  hemagglutinin__InfluenzaA__AIL94918

SEQ ID NO: 12676 - protein, 566 aa, Artificial Sequence; identical to SEQ ID NO: 9994
  hemagglutinin__InfluenzaA__AIL94930

SEQ ID NO: 12677 - protein, 566 aa, Artificial Sequence; identical to SEQ ID NO: 9994
  hemagglutinin__InfluenzaA__AIL94942

SEQ ID NO: 12678 - protein, 566 aa, Artificial Sequence; identical to SEQ ID NO: 10040
  hemagglutinin__InfluenzaA__AIL94954

SEQ ID NO: 12679 - protein, 566 aa, Artificial Sequence; identical to SEQ ID NO: 9858
  hemagglutinin__InfluenzaA__AIL94965

SEQ ID NO: 12680 - protein, 566 aa, Artificial Sequence
  hemagglutinin__InfluenzaA__AIM55837
MKAILVVLLYTFATATADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLSLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12681 - protein, 566 aa, Artificial Sequence
  hemagglutinin__InfluenzaA__AIM55848
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNTELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12682 - protein, 566 aa, Artificial Sequence; identical to SEQ ID NO: 10040
  hemagglutinin__InfluenzaA__AIM55859

SEQ ID NO: 12683 - protein, 566 aa, Artificial Sequence; identical to SEQ ID NO: 10040
  hemagglutinin__InfluenzaA__AIM55870

SEQ ID NO: 12684 - protein, 566 aa, Artificial Sequence; identical to SEQ ID NO: 10040
  hemagglutinin__InfluenzaA__AIM55881

SEQ ID NO: 12685 - protein, 566 aa, Artificial Sequence; identical to SEQ ID NO: 11902
  hemagglutinin__InfluenzaA__AIM55893

SEQ ID NO: 12686 - protein, 566 aa, Artificial Sequence; identical to SEQ ID NO: 11021
  hemagglutinin__InfluenzaA__AIM55904

SEQ ID NO: 12687 - protein, 566 aa, Artificial Sequence; identical to SEQ ID NO: 10040
  hemagglutinin__InfluenzaA__AIM55915

SEQ ID NO: 12688 - protein, 569 aa, Artificial Sequence
  hemagglutinin__InfluenzaA__AIM55926
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12689 - protein, 566 aa, Artificial Sequence; identical to SEQ ID NO: 10040
  hemagglutinin__InfluenzaA__AIM55937

SEQ ID NO: 12690 - protein, 566 aa, Artificial Sequence; identical to SEQ ID NO: 11021
  hemagglutinin__InfluenzaA__AIM55948

SEQ ID NO: 12691 - protein, 566 aa, Artificial Sequence; identical to SEQ ID NO: 11003
  hemagglutinin__InfluenzaA__AIM55962

SEQ ID NO: 12692 - protein, 566 aa, Artificial Sequence; identical to SEQ ID NO: 11021
  hemagglutinin__InfluenzaA__AIM55984

SEQ ID NO: 12693 - protein, 566 aa, Artificial Sequence; identical to SEQ ID NO: 11902
  hemagglutinin__InfluenzaA__AIM55995

SEQ ID NO: 12694 - protein, 566 aa, Artificial Sequence
  hemagglutinin__InfluenzaA__AIM56017
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGHSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12695 - protein, 566 aa, Artificial Sequence; identical to SEQ ID NO: 12694
  hemagglutinin__InfluenzaA__AIM56028

SEQ ID NO: 12696 - protein, 566 aa, Artificial Sequence
  hemagglutinin__InfluenzaA__AIM56039
MKAILVVLLYPFATANADTLCIGYHANNSTDTVDTVLEKNVTVTHSVNLLEDKHNGKLCKLRGVAPLHLGKCNIAGWILGNPECESLSTASSWSYIVEASSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12697 - protein, 566 aa, Artificial Sequence
  hemagglutinin__InfluenzaA__AIM56050
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNRGKIDGVKLESTRIYQILAIYSTVASSLVLVVSLGAISFWMCSNGSLQCRICI

SEQ ID NO: 12698 - protein, 566 aa, Artificial Sequence; identical to SEQ ID NO: 10040
  hemagglutinin__InfluenzaA__AIM56061

SEQ ID NO: 12699 - protein, 566 aa, Artificial Sequence; identical to SEQ ID NO: 10040
  hemagglutinin__InfluenzaA__AIM56072

SEQ ID NO: 12700 - protein, 566 aa, Artificial Sequence; identical to SEQ ID NO: 11893
  hemagglutinin__InfluenzaA__AIM56083

SEQ ID NO: 12701 - protein, 566 aa, Artificial Sequence; identical to SEQ ID NO: 10040
  hemagglutinin__InfluenzaA__AIM56105

SEQ ID NO: 12702 - protein, 566 aa, Artificial Sequence; identical to SEQ ID NO: 10040
  hemagglutinin__InfluenzaA__AIM56116

SEQ ID NO: 12703 - protein, 566 aa, Artificial Sequence
  hemagglutinin__InfluenzaA__AIM56127
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKASSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12704 - protein, 566 aa, Artificial Sequence; identical to SEQ ID NO: 10040
  hemagglutinin__InfluenzaA__AIM56138

SEQ ID NO: 12705 - protein, 566 aa, Artificial Sequence; identical to SEQ ID NO: 10040
  hemagglutinin__InfluenzaA__AIM56149

SEQ ID NO: 12706 - protein, 566 aa, Artificial Sequence; identical to SEQ ID NO: 11893
  hemagglutinin__InfluenzaA__AIM56160

SEQ ID NO: 12707 - protein, 566 aa, Artificial Sequence; identical to SEQ ID NO: 10040
  hemagglutinin__InfluenzaA__AIM56171

SEQ ID NO: 12708 - protein, 566 aa, Artificial Sequence
  hemagglutinin__InfluenzaA__AIM56182
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKASSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNKEKIDGVKLESTRIYQILAIYSTVASSLVLVVSLGAISFWMCSNGSLQCRICI

SEQ ID NO: 12709 - protein, 566 aa, Artificial Sequence
  hemagglutinin__InfluenzaA__AIM56193
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKVTFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12710 - protein, 566 aa, Artificial Sequence; identical to SEQ ID NO: 10040
  hemagglutinin__InfluenzaA__AIM56204

SEQ ID NO: 12711 - protein, 566 aa, Artificial Sequence; identical to SEQ ID NO: 10040
  hemagglutinin__InfluenzaA__AIM56215

SEQ ID NO: 12712 - protein, 566 aa, Artificial Sequence; identical to SEQ ID NO: 10040
  hemagglutinin__InfluenzaA__AIM56226

SEQ ID NO: 12713 - protein, 566 aa, Artificial Sequence; identical to SEQ ID NO: 12451
  hemagglutinin__InfluenzaA__AIM56237

SEQ ID NO: 12714 - protein, 566 aa, Artificial Sequence; identical to SEQ ID NO: 10040
  hemagglutinin__InfluenzaA__AIM56259

SEQ ID NO: 12715 - protein, 566 aa, Artificial Sequence
  hemagglutinin__InfluenzaA__AIM56270
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAVNTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12716 - protein, 566 aa, Artificial Sequence; identical to SEQ ID NO: 10040
  hemagglutinin__InfluenzaA__AIM56281

SEQ ID NO: 12717 - protein, 566 aa, Artificial Sequence
  hemagglutinin__InfluenzaA__AIM56292
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEILVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12718 - protein, 566 aa, Artificial Sequence
  hemagglutinin__InfluenzaA__AIM56303
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTQVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12719 - protein, 566 aa, Artificial Sequence
  hemagglutinin__InfluenzaA__AIM56314
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKKLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12720 - protein, 566 aa, Artificial Sequence; identical to SEQ ID NO: 10040
  hemagglutinin__InfluenzaA__AIM56325

SEQ ID NO: 12721 - protein, 566 aa, Artificial Sequence
  hemagglutinin__InfluenzaA__AIM56336
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKIRNQLKNNAKEIGNGCFEFYHKCDNMCMESVKNGTYDYPKYSEEAKLNREKIDGVKLESTRIYQILAIYSTVASSLVLVVSLGAISFWMCSNGSLQCRICI

SEQ ID NO: 12722 - protein, 566 aa, Artificial Sequence
  hemagglutinin__InfluenzaA__AIM56347
MKAILVVLLYTFATANADTLCIGYHANNSTDTVDTVLEKNVTVTHSVNLLEDKHNGKLCKLRGVAPLHLGKCNIAGWILGNPECESLSTTSSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12723 - protein, 566 aa, Artificial Sequence
  hemagglutinin__InfluenzaA__AIM56358
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVKPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12724 - protein, 566 aa, Artificial Sequence; identical to SEQ ID NO: 10040
  hemagglutinin__InfluenzaA__AIM56369

SEQ ID NO: 12725 - protein, 566 aa, Artificial Sequence
  hemagglutinin__InfluenzaA__AIM56380
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLSREKIDGVKLESTRIYQILAIYSTVASSLVLVVSLGAISFWMCSNGSLQCRICI

SEQ ID NO: 12726 - protein, 566 aa, Artificial Sequence; identical to SEQ ID NO: 10040
  hemagglutinin__InfluenzaA__AIM56391

SEQ ID NO: 12727 - protein, 566 aa, Artificial Sequence; identical to SEQ ID NO: 10040
  hemagglutinin__InfluenzaA__AIM56402

SEQ ID NO: 12728 - protein, 566 aa, Artificial Sequence; identical to SEQ ID NO: 11893
  hemagglutinin__InfluenzaA__AIM56413

SEQ ID NO: 12729 - protein, 566 aa, Artificial Sequence; identical to SEQ ID NO: 10040
  hemagglutinin__InfluenzaA__AIM56425

SEQ ID NO: 12730 - protein, 566 aa, Artificial Sequence; identical to SEQ ID NO: 10040
  hemagglutinin__InfluenzaA__AIM56436

SEQ ID NO: 12731 - protein, 566 aa, Artificial Sequence; identical to SEQ ID NO: 10040
  hemagglutinin__InfluenzaA__AIM56447

SEQ ID NO: 12732 - protein, 566 aa, Artificial Sequence; identical to SEQ ID NO: 10040
  hemagglutinin__InfluenzaA__AIM56469

SEQ ID NO: 12733 - protein, 566 aa, Artificial Sequence
  hemagglutinin__InfluenzaA__AIM56480
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITLGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12734 - protein, 566 aa, Artificial Sequence; identical to SEQ ID NO: 10040
  hemagglutinin__InfluenzaA__AIM56491

SEQ ID NO: 12735 - protein, 569 aa, Artificial Sequence
  hemagglutinin__InfluenzaA__AIM56502
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKASSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12736 - protein, 566 aa, Artificial Sequence; identical to SEQ ID NO: 10040
  hemagglutinin__InfluenzaA__AIM56513

SEQ ID NO: 12737 - protein, 566 aa, Artificial Sequence; identical to SEQ ID NO: 11985
  hemagglutinin__InfluenzaA__AIM56524

SEQ ID NO: 12738 - protein, 566 aa, Artificial Sequence; identical to SEQ ID NO: 10040
  hemagglutinin__InfluenzaA__AIM56535

SEQ ID NO: 12739 - protein, 566 aa, Artificial Sequence; identical to SEQ ID NO: 10040
  hemagglutinin__InfluenzaA__AIM56546

SEQ ID NO: 12740 - protein, 566 aa, Artificial Sequence; identical to SEQ ID NO: 11893
  hemagglutinin__InfluenzaA__AIM56557

SEQ ID NO: 12741 - protein, 566 aa, Artificial Sequence
  hemagglutinin__InfluenzaA__AIM56568
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFSKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12742 - protein, 566 aa, Artificial Sequence
  hemagglutinin__InfluenzaA__AIM56579
MKAILVVLLYTFATTNADTLCIGYHANNSTDTVDTVLEKNVTVTHSVNLLEDEHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNTDAYVFVGTSRYSKKFKPEIAIRPKVRDQEGRMSYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12743 - protein, 569 aa, Artificial Sequence
  hemagglutinin__InfluenzaA__AIM56590
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDDTCMESVKNGTYDYPKYSEEAKLNREKIDGVKLESTRIYQILAIYSTVASSLVLVVSLGAISFWMCSNGSLQCRICI

SEQ ID NO: 12744 - protein, 569 aa, Artificial Sequence
  hemagglutinin__InfluenzaA__AIM56601
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12745 - protein, 569 aa, Artificial Sequence
  hemagglutinin__InfluenzaA__AIM56612
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNTGSGIIISDTPVHDCNTTCQTPEGAINTSLTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12746 - protein, 566 aa, Artificial Sequence
  hemagglutinin__InfluenzaA__AIM56623
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLTWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12747 - protein, 566 aa, Artificial Sequence
  hemagglutinin__InfluenzaA__AIM56634
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12748 - protein, 569 aa, Artificial Sequence
  hemagglutinin__InfluenzaA__AIM56645
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLTSLPFQNIHPITIGKCPKYVKSTKLRLATGLRNVPSIQSRGLFGAIAGFIEGGWTGMVDGWYGYHHQNEQGSGYAADQKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12749 - protein, 566 aa, Artificial Sequence
  hemagglutinin__InfluenzaA__AIM56656
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTNSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNIVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12750 - protein, 566 aa, Artificial Sequence; identical to SEQ ID NO: 10040
  hemagglutinin__InfluenzaA__AIM56667

SEQ ID NO: 12751 - protein, 566 aa, Artificial Sequence
  hemagglutinin__InfluenzaA__AIM56678
MKAILVVLLYTFATANADTLCIGYHANNSTDTVDTVLEKNVTVTHSVNLLEDKHNGKLCKLRGVPPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12752 - protein, 566 aa, Artificial Sequence; identical to SEQ ID NO: 12388
  hemagglutinin__InfluenzaA__AIM56689

SEQ ID NO: 12753 - protein, 566 aa, Artificial Sequence; identical to SEQ ID NO: 10040
  hemagglutinin__InfluenzaA__AIM56700

SEQ ID NO: 12754 - protein, 569 aa, Artificial Sequence
  hemagglutinin__InfluenzaA__AIM56711
MKAILVVLLYTFATANADTLCIGYHANNSTDTVDTVLEKNVTVTHSVNLLEDKHNGKLCKLRGVPPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12755 - protein, 566 aa, Artificial Sequence; identical to SEQ ID NO: 12388
  hemagglutinin__InfluenzaA__AIM56722

SEQ ID NO: 12756 - protein, 566 aa, Artificial Sequence; identical to SEQ ID NO: 10040
  hemagglutinin__InfluenzaA__AIM56733

SEQ ID NO: 12757 - protein, 566 aa, Artificial Sequence; identical to SEQ ID NO: 10040
  hemagglutinin__InfluenzaA__AIM56744

SEQ ID NO: 12758 - protein, 566 aa, Artificial Sequence
  hemagglutinin__InfluenzaA__AIM56755
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPSHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12759 - protein, 569 aa, Artificial Sequence; identical to SEQ ID NO: 12744
  hemagglutinin__InfluenzaA__AIM56766

SEQ ID NO: 12760 - protein, 566 aa, Artificial Sequence
  hemagglutinin__InfluenzaA__AIM56777
MKAILVVLLYTFATANADTLCIGYHANNSTDTVDTVLEKNVTVTHSVNLLEGKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPYQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12761 - protein, 566 aa, Artificial Sequence; identical to SEQ ID NO: 10040
  hemagglutinin__InfluenzaA__AIM56788

SEQ ID NO: 12762 - protein, 566 aa, Artificial Sequence; identical to SEQ ID NO: 10040
  hemagglutinin__InfluenzaA__AIM56799

SEQ ID NO: 12763 - protein, 566 aa, Artificial Sequence; identical to SEQ ID NO: 10040
  hemagglutinin__InfluenzaA__AIM56810

SEQ ID NO: 12764 - protein, 566 aa, Artificial Sequence; identical to SEQ ID NO: 10040
  hemagglutinin__InfluenzaA__AIM56821

SEQ ID NO: 12765 - protein, 560 aa, Artificial Sequence
  hemagglutinin__InfluenzaA__AIN76383
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGTTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 12766 - protein, 562 aa, Artificial Sequence
  hemagglutinin__InfluenzaA__AIP93103
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDGWTQHETDGGSKACAVSGKPSFFRNMVWLTKKGPNYPVAKRSYNNTSGEQMLIIWGVHHPNDEAEQRALYQNVGTYVSASTSTLNKRSTPEIAARPKVSGLGSRMEFSWTLLDVWDTISFESTGNLVAPEYGFKISKRGSSGIMKTEGTLGNCETKCQTPLGAINTTLPFHNVHPLTIGECPKYVKSEKLVLATGPRNVPQIESRGLFGAIAGFIEGGWQGMVDGWYGYHHSNDQGSGYAADKESTQKAFDRITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDDECMNSVKNGTYDYPKYEEESKLKRNEIKGVKLSSMGVYQILAIYATVAGSLSLAIMIAGISFWMCSNGSLQCRICI

SEQ ID NO: 12767 - protein, 562 aa, Artificial Sequence; identical to SEQ ID NO: 1655
  hemagglutinin__InfluenzaA__AIP93115

SEQ ID NO: 12768 - protein, 566 aa, Artificial Sequence
  hemagglutinin__InfluenzaA__AIR93971
MKAILVVLLYTFATTNADILCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGARSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIITSDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12769 - protein, 566 aa, Artificial Sequence
  hemagglutinin__InfluenzaA__AIR93982
MKAILVVLLYTIATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGARSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFTMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12770 - protein, 566 aa, Artificial Sequence
  hemagglutinin__InfluenzaA__AIR93993
MKAILVVLLYTFATANADTLCIGYHANNSTDTVDTVLEKNVTVTHSVNLLEDKHNGKLCKLKGVAPLHLGKCNIAGWILGNPECGSLSTASSWSYIVETSSSDNGTCYPGDFIDYEELREQLSSVSSFERFEIFPKTSSWPNHDSNKGVTAACPNAGSKSFYKNLIWLVKKGNSYPKLSKSYINDKGKEVLVLWGIHHPSTSADQQSLYQNADAYVFVGTSRYSKKFKPEIAIRPKVRGQEGRMDYYWTLVEPGDKITFEATGNLVVPRYAFAMERNTGSGIIISDTPVHDCNTICQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGKGCFEFYHKCDTMCMESVKNGTYDYPKYSEEAKLNREEIDGVKLESTRIYQILAIYSTVASSLVLVVSLGAISFWMCSNGSLQCRICI

SEQ ID NO: 12771 - protein, 566 aa, Artificial Sequence
  hemagglutinin__InfluenzaA__AIR94000
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSFPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12772 - protein, 560 aa, Artificial Sequence
  hemagglutinin__InfluenzaA__AIR94116
METASLITILLVVTVSNADKICIGYQSTNSTETVDTLTENNVPVTHAKELLHTEHNGMLCATSLGHPLILDTCTIEGLIYGNPSCDLLLGGREWSYIVERPSAVNGLCYPGNVENLEELRSLFSSARSYQRIQIFPDTIWNVSYSGTSKACSDSFYRSMRWLTQKDNAYPIQDAQYTNNQGKNILFMWGINHPPTDTAQTNLYTRTDTTTSVATEEINRTFKPLIGPRPLVNGLMGRINYYWSVLKPGQTLRIKSNGNLIAPWYGHILSGESHGRILKTDLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFNEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 12773 - protein, 566 aa, Artificial Sequence
  hemagglutinin__InfluenzaA__AIT38333
MKTIITLSYILCHVFAQKIHGSDSSTATLCLGHHAVPNGTLVKTITNDQIEVTNATELVQSSSTGRICDNPHRILDGKNCTLIDALLGDPHCDEFQNKEWDLFVERSNAYSDCYPYYVPDYASLRSLVASSGTLEFNNESFNWTGISQDGTSSSCRRGSVKSFFSRLNWLHGLEYKYPAQNVTMLNNDEFDKLYIWGVHHPSTDSDQTSLYVQTSGRVTVSTKRSQQTVIPNIGSRPWVRGISSRISIHWTIVKPGDILLINSTGNLIAPRGYFKIRGGKSSIMRSDAPIDNCDSECVTPNGNIPNDKPFQNVNRITYGPCPRYIKQNTLKLATGMRNVPEKQTRGVLGAIAGFIENGWEGMVDGWYGFRHQNSEGTGQAADLKSTQAAIDQINGKLNRLIGKTNEKFHQIEKEFSEIEGRVQDLEKYVEDTKIDLWSYNAELLVVLENQHTIDLTDSEMNKLFERTRRQLRENAEDMGNGCFKIYHKCDNACIGSIRNGTYVHDVYRDEALNNRFQIKGVELKSGYKDWILWISFAISCFLLCAVLLGFITWACQKGNIRCNICI

SEQ ID NO: 12774 - protein, 565 aa, Artificial Sequence
  hemagglutinin__InfluenzaA__AIT38344
MKIKLLILLCTFTATYADTICIGYHANNSTDTVDTVLEKNVTVTHSVNLLEDSHNGKLCLLRGIAPLQLGNCSVAGWILGNPECESLISKESWSYIVEKPNPENGTCYPGYFADYEELREQLSSVSSFERFEIFPKESSWPNHTVTGVSASCSYNGKGNFYKNLLWLTRKNGLYPNLSKSYTNNKEKEVLILWGVHHPSNIKDQRTLYHTENAYVSVVSSHYSRRFTPEITKRPKVRDQEGRINYYWTLLEPGDTIIFEANGNLIAPWYAFALSRGFGSGIITSNAPMDECEAKCQTPRGAINSSLPFQNVHPVTIGECPKYVRSAKLRMVTGLRNIPSIQSRGLFGAIAGFIEGGWTGMIDGWYGYHHQNEQGSGYAADKESTQNAINGITNKVNSVIEKMNTQFTTVGKEFNKLERRMENLNKKVDDGFLDIWTYNAELLVLLENERTLDFHDSNVKILYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 12775 - protein, 565 aa, Artificial Sequence
  hemagglutinin__InfluenzaA__AIT38360
MKIKLLILLCTFTATYADTICIGYHANNSTDTVDTVLEKNVTVTHSVNLLEDSHNGKLCLLKGIAPLQLGNCSVAGWILGNPECESLISKESWSYIVEKPNPENGTCYPGYFADYEELREQLSSVSSFERFEIFPKESSWPNHTVTGVSASCSYNGKGNFYKNLLWLTRKNGLYPNLSKSYTNNKEKEVLILWGVHHPSNIEDQRTLYHTENAYVSVVSSHYSRRFTPEITKRPKVRGQEGRINYYWTLLEPGDTIIFEANGNLIAPWYAFALSRGLGSGIITSNAPMDECEAKCQTPRGAINSSLPFQNVHPVTIGECPKYVRSAKLRMVTGLRNIPSIQSRGLFGAIAGFIEGGWTGMIDGWYGYHHQNEQGSGYAADKESTQNAINGITNKVNSVIEKMNTQFTTVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 12776 - protein, 566 aa, Artificial Sequence; identical to SEQ ID NO: 10040
  hemagglutinin__InfluenzaA__AIT93147

SEQ ID NO: 12777 - protein, 566 aa, Artificial Sequence; identical to SEQ ID NO: 2669
  hemagglutinin__InfluenzaA__AIU39700

SEQ ID NO: 12778 - protein, 566 aa, Artificial Sequence
  hemagglutinin__InfluenzaA__AIU39702
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSFPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12779 - protein, 566 aa, Artificial Sequence; identical to SEQ ID NO: 6909
  hemagglutinin__InfluenzaA__AIU39704

SEQ ID NO: 12780 - protein, 567 aa, Artificial Sequence
  hemagglutinin__InfluenzaA__AIU46609
MEKIVLLLAIVSLVKSDQICIGYHANNSTEQVDTIMEKNVTVTHAQDILEKTHNGKLCDLNGVKPLILKDCSVAGWLLGNPMCDEFIRVPEWSYIVERANPANDLCYPGNLNDYEELKHLLSRINHFEKILIIPKSSWTNHETSLGVSAACPYQGTPSFFRNVVWLIKKNDAYPTIKISYNNTNQEDLLILWGIHHSNNAAEQTNLYKNPTTYISVGTSTLNQRLVPKIATRSQVNGQRGRMDFFWTILKPNDAIHFESNGNFIAPEYAYKIVKKGDSTIMKSEVEYGHCNTKCQTPIGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIIVAGLSLWMCSNGSLQCRICI

SEQ ID NO: 12781 - protein, 562 aa, Artificial Sequence
  hemagglutinin__InfluenzaA__AIU46714
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPKYSLCYPGSFNDYEELKHLLSSVKHFEKVKILPKDGWTQHKTDGGSKACAVSGKQSFFRNMVWLTKKGQNYPVAKRSYNNTSGEQMLIIWGVHHPNDEEEQRALYQKVGTYVSASTSTLNKRSTPEIAARPEVNGLGSRMEFSWTLLDVWDTINFESTGNLVAPEYGFKISKRGSSGIIKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDRITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDNECMNSVKNGTYDYPKYEEESKLKRNEIKGVKLSSMGVYQILAIYATVAGSLSLAIMIAGISFWMCSNGSLQCRICI

SEQ ID NO: 12782 - protein, 566 aa, Artificial Sequence
  hemagglutinin__InfluenzaA__AIV09219
MKAILVVLLYTFATTNADILCIGYHANNSTDTVDTVLEKNVTVTHSVNLLEDKHNGKLCKLRGVAPLHLGKCNIAGWILGNPECELLSTTSSWSYIVETSSSDNGTCYPGDFIDYEELREQLSSVSSFERFEIFPKTSSWPDHDSNKGVTAACPHAGAGSFYKNLIWLVKKGNSYPKLSKSYINDKGKEVLVLWGIHHPPTSADQQRLYQNADAYVFVGTSRYSKKFKPEIAIRPKVRDQEGRMNYYWTLVEPGDKITFEATGNLVVPRYAFAMERNAGSGIITSDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIDKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12783 - protein, 566 aa, Artificial Sequence
  hemagglutinin__InfluenzaA__AIW60689
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSDCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSIYVQASGRVTVSTKRSQQTVIPNIGSRPWVRGISSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNYEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDAYRDEALNNRFQIKGVELKSGYKDWILWISFAISCFLLCVVLLGFIMWACQKGNIRCNICI

SEQ ID NO: 12784 - protein, 566 aa, Artificial Sequence
  hemagglutinin__InfluenzaA__AIW60690
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSDCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNYEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDAYRDEALNNRFQIKGVELKSGYKDWILWISFAISCFLLCVVLLGFIMWACQKGNIRCNICI

SEQ ID NO: 12785 - protein, 566 aa, Artificial Sequence
  hemagglutinin__InfluenzaA__AIW60691
MKTIIALSYILCLVFAQKLPGNDNSTATLCLGHHAVPNGTLVKAITNDQIEVTNATELVQSSSTGRICDSPHRILDGKNCTLIDALLGDPHCDGFQNKEWDLFVERSKAYSDCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTRLYVQASGRVTVSTKRSQQTVIPNIGSRPWVRGISSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12786 - protein, 566 aa, Artificial Sequence
  hemagglutinin__InfluenzaA__AIW60692
MKTIIALSYILCLVFAQKLPGNDNSTATLCLGHHAVPNGTLVKAITNDQIEVTNATELVQSSSTGRICDSPHRILDGKNCTLIDALLGDPHCDGFQNKEWDLFVERSKAYSDCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12787 - protein, 566 aa, Artificial Sequence
  hemagglutinin__InfluenzaA__AIW60693
MKTIIALSYILCLVFAQKLPGNDNSTATLCLGHHAVLNGTLVKTITNDQIEVTNATELVQNSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQTSIYAQASGRVTVSTKRSQQTVIPNIGSRPWVRGVSSIISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12788 - protein, 566 aa, Artificial Sequence
  hemagglutinin__InfluenzaA__AIW60694
MKTIIALSYILCLVFAQKLPGNDNSTATLCLGHHAVLNGTLVKTITNDQIEVTNATELVQNSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12789 - protein, 566 aa, Artificial Sequence
  hemagglutinin__InfluenzaA__AIW60695
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLNYKYPALNVTMPNNEKFDKLYIWGVHHPSTDSDQISIYAQAPGRVTVSTKRSQQTVIPNIGSRPWVRGVSSIISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12790 - protein, 566 aa, Artificial Sequence
  hemagglutinin__InfluenzaA__AIW60696
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVDQNGTSSACKRRSNKSFFSRLNWLHQLKYKYPALNVAMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 12791 - protein, 566 aa, Artificial Sequence
  hemagglutinin__InfluenzaA__AIW60697
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSSCKRRSNKSFFSRLNWLTHLKYKYPALNVTMPNNEKFDKLYIWGVHHPDTDSVQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12792 - protein, 566 aa, Artificial Sequence
  hemagglutinin__InfluenzaA__AIW60698
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12793 - protein, 566 aa, Artificial Sequence
  hemagglutinin__InfluenzaA__AIW60699
MKTIIALSYILCLVFAQKLPGNDNSTATLCIGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEEFDKLYIWGVHHPVTDNDQISLYAQASGKITVSTKRSQQTVIPNIGSRPRVRDIPSRISIYWTIVKPGDILLIKSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEETKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12794 - protein, 566 aa, Artificial Sequence
  hemagglutinin__InfluenzaA__AIW60700
MKTIIALSYILCLVFAQKLPGNDNSTATLCIGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEEFDKLYIWGVHHPGTDNDQISLYAQASGKITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEETKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12795 - protein, 566 aa, Artificial Sequence
  hemagglutinin__InfluenzaA__AIW60701
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12796 - protein, 566 aa, Artificial Sequence
  hemagglutinin__InfluenzaA__AIW60702
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12797 - protein, 566 aa, Artificial Sequence; identical to SEQ ID NO: 12541
  hemagglutinin__InfluenzaA__AIZ07211

SEQ ID NO: 12798 - protein, 566 aa, Artificial Sequence
  hemagglutinin__InfluenzaA__AIZ07212
MKTIMALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12799 - protein, 560 aa, Artificial Sequence
  hemagglutinin__InfluenzaA__AJD78175
METASLITILLVVTVSNADKICIGYQSTNSTETVDTLTENNVPVTHAKELLHTEHNGMLCATSLGQPLILDTCTIEGLIYGNPSCDLLLGGREWSYIVERPSAANGLCYPGNVENLEELRSLFSSARSYQRIQIFPDTIWNVSYSGTSKACSDSFYRSMRWLTQKDNTYPIQDAQYTNNQGKNILFMWGINHPPTDTAQTNLYTRTDTTTSVATEEINRTFKPLIGPRPLVNGLMGRINYYWSVLKPGQTLRIKSNGNLIAPWYGHILSGESHGRILKTDLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFNEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 12800 - protein, 560 aa, Artificial Sequence
  hemagglutinin__InfluenzaA__AJD78187
METASLITILLVVTVSNADKICIGYQSTNSTETVDTLTENNVPVTHAKELLHTEHNGMLCATSLGHPLILDTCTIEGLIYGNPSCDLLLGGREWSYIVERPSAVNGLCYPGNVENLEELRSLFSSARSYQRIQIFPDTIWNVSYSGTSKTCSDSFYRSMRWLTQKDNAYPIQDAQYTNNQGKNILFMWGINHPPTDTTQTNLYTRTDTTTSVATEEINRTFKPLIGPRPLVNGLMGRINYYWSVLKPGQTLRIKSNGNLIAPWYGHILSGESHGRILKTDLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 12801 - protein, 560 aa, Artificial Sequence
  hemagglutinin__InfluenzaA__AJD78199
METVSLITILLVATVSNADKICIGYQSTNSTETVDTLTENNVPVTHAKELLHTEHNGMLCATSLGQPLILDTCTIEGLIYGNPSCDLSLEGREWSYIVERPSAVNGLCYPGNVENLEELRSLFSSARSYQRIQIFPDTIWNVSYDGTSTACSGSFYRSMRWLTRKNGDYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 12802 - protein, 560 aa, Artificial Sequence
  hemagglutinin__InfluenzaA__AJD78211
METVSLITILLVATVSNADKICIGYQSTNSTETVDTLTENNVPVTHAKELLHTEHNGMLCATSLGQPLILDTCTIEGLIYGNPSCDLSLEGREWSYIVERPSAVNGLCYPGNVENLEELRSLFSSARSYQRIQIFPDTIWNVSYDGTSTACSGSFYRSMRWLTRKNGDYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKRGSCTVQCQTEKGGLNTTLPFQNVSKYAFGNCSKYIGIKSLKLAVGLRNVPSRSRRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 12803 - protein, 562 aa, Artificial Sequence
  hemagglutinin__InfluenzaA__AJI76401
MAIIYLILLFATVRGDQICIGYHANNSTEKVDTILERNVTVTHAKDILEKTHNGKLCKLNGIPPLELGDCSIAGWLLGNPECDRLLRVPEWSYIMEKENPRYSLCYPGSLNDYEELKHLLSSVKHFEKVRILPKDRWTNHTTTGGSKACAVSGKPSFFRNMVWLTKKGPNYPVAKGSYNNTSGEQMLIIWGVHHPIDEAEQRALYQNVGTYVSASTSTLYKRSIPEIAARPEVNGLGSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFNNLEKRLENLNKRMEDGFLDVWTYNAELLVLMENERTLDFHDSNVKNLYEKVRMQLRDNVRELGNGCFEFYHKCDDECMNSVKNGTYDYPKYEEESKLKRNEIKGVKLSSMGVYQILAIYATVAGSLSLAIMVAGISFWMCSNGSLQCRICI

SEQ ID NO: 12804 - protein, 566 aa, Artificial Sequence; identical to SEQ ID NO: 12065
  hemagglutinin__InfluenzaA__AJI80137

SEQ ID NO: 12805 - protein, 566 aa, Artificial Sequence; identical to SEQ ID NO: 12065
  hemagglutinin__InfluenzaA__AJI80149

SEQ ID NO: 12806 - protein, 566 aa, Artificial Sequence; identical to SEQ ID NO: 10040
  hemagglutinin__InfluenzaA__AJI80161

SEQ ID NO: 12807 - protein, 566 aa, Artificial Sequence
  hemagglutinin__InfluenzaA__AJI80172
MKTIIALSYILCLVFAQKLPGNDNSTATLCLGHHAVPNGTIVKTITNDRIEVTNATELVQNSSIGEICDSPHQILDGENCSLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12808 - protein, 566 aa, Artificial Sequence
  hemagglutinin__InfluenzaA__AJI80196
MKTIIALSYILCLVFAQKLPGNDNSTATLCLGHHAVPNGTIVKTITNDRIEVTNATELVQNSSIGEICDSPHQILDGENCTLIDALLGDPQCDGFQNKEWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNINRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAEFLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12809 - protein, 566 aa, Artificial Sequence; identical to SEQ ID NO: 12615
  hemagglutinin__InfluenzaA__AJI80208

SEQ ID NO: 12810 - protein, 566 aa, Artificial Sequence; identical to SEQ ID NO: 9994
  hemagglutinin__InfluenzaA__AJI80220

SEQ ID NO: 12811 - protein, 566 aa, Artificial Sequence; identical to SEQ ID NO: 12807
  hemagglutinin__InfluenzaA__AJI80232

SEQ ID NO: 12812 - protein, 566 aa, Artificial Sequence; identical to SEQ ID NO: 9994
  hemagglutinin__InfluenzaA__AJI80244

SEQ ID NO: 12813 - protein, 566 aa, Artificial Sequence; identical to SEQ ID NO: 9858
  hemagglutinin__InfluenzaA__AJI80256

SEQ ID NO: 12814 - protein, 566 aa, Artificial Sequence; identical to SEQ ID NO: 9994
  hemagglutinin__InfluenzaA__AJI80268

SEQ ID NO: 12815 - protein, 566 aa, Artificial Sequence
  hemagglutinin__InfluenzaA__AJI80280
MKTIIALSYILCLVFAQKLPGNDNSTATLCLGHHAVPNGTIVKTITNDRIEVTNATELVQNSSIGKICDSPHQILDGENCTLIDALLGDPQCDGFQNKEWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12816 - protein, 566 aa, Artificial Sequence; identical to SEQ ID NO: 12587
  hemagglutinin__InfluenzaA__AJI80292

SEQ ID NO: 12817 - protein, 566 aa, Artificial Sequence; identical to SEQ ID NO: 12615
  hemagglutinin__InfluenzaA__AJI80303

SEQ ID NO: 12818 - protein, 566 aa, Artificial Sequence; identical to SEQ ID NO: 12587
  hemagglutinin__InfluenzaA__AJI80315

SEQ ID NO: 12819 - protein, 566 aa, Artificial Sequence
  hemagglutinin__InfluenzaA__AJI80326
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMEKNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12820 - protein, 566 aa, Artificial Sequence
  hemagglutinin__InfluenzaA__AJI80337
MKAILVVLLYTFATANADTLCIGYHANNSTDTVDTVLEKNVTVTHSINLLEDKHNGKLCKLRGVAPLHLGKCNIAGWILGNPECESLSTASSWSYIVETSSSDNGTCYPGDFINYEELREQLSSVSSFERFEMFPKTSSWPNHDSNKGVTAACPHAGAKSFYKNLIWLVKKGNSYPKLSKSYINDKGKEVLVLWGIHHPSTTADQQSLYQNANAYVFVGTSKYSKKFKPEIAIRPKVRDQEGRMNYYWTLIEPGDKITFEATGNLVVPRYAFAMERNAGSGIIISDTPVHDCNTTCQTPEGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12821 - protein, 566 aa, Artificial Sequence; identical to SEQ ID NO: 9994
  hemagglutinin__InfluenzaA__AJI80348

SEQ ID NO: 12822 - protein, 566 aa, Artificial Sequence; identical to SEQ ID NO: 9858
  hemagglutinin__InfluenzaA__AJI80360

SEQ ID NO: 12823 - protein, 566 aa, Artificial Sequence; identical to SEQ ID NO: 9858
  hemagglutinin__InfluenzaA__AJI80372

SEQ ID NO: 12824 - protein, 566 aa, Artificial Sequence; identical to SEQ ID NO: 10040
  hemagglutinin__InfluenzaA__AJI80384

SEQ ID NO: 12825 - protein, 566 aa, Artificial Sequence; identical to SEQ ID NO: 10040
  hemagglutinin__InfluenzaA__AJI80395

SEQ ID NO: 12826 - protein, 566 aa, Artificial Sequence; identical to SEQ ID NO: 10040
  hemagglutinin__InfluenzaA__AJI80406

SEQ ID NO: 12827 - protein, 566 aa, Artificial Sequence; identical to SEQ ID NO: 10040
  hemagglutinin__InfluenzaA__AJI80417

SEQ ID NO: 12828 - protein, 566 aa, Artificial Sequence; identical to SEQ ID NO: 10040
  hemagglutinin__InfluenzaA__AJI80428

SEQ ID NO: 12829 - protein, 566 aa, Artificial Sequence; identical to SEQ ID NO: 9994
  hemagglutinin__InfluenzaA__AJI80439

SEQ ID NO: 12830 - protein, 566 aa, Artificial Sequence; identical to SEQ ID NO: 9994
  hemagglutinin__InfluenzaA__AJI80462

SEQ ID NO: 12831 - protein, 566 aa, Artificial Sequence
  hemagglutinin__InfluenzaA__AJI80474
MKAILVVLLYTFATANADTLCIGYHANNSTDTVDTVLEKNVTVTHSINLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12832 - protein, 566 aa, Artificial Sequence; identical to SEQ ID NO: 12831
  hemagglutinin__InfluenzaA__AJI80485

SEQ ID NO: 12833 - protein, 566 aa, Artificial Sequence; identical to SEQ ID NO: 10040
  hemagglutinin__InfluenzaA__AJI80496

SEQ ID NO: 12834 - protein, 566 aa, Artificial Sequence; identical to SEQ ID NO: 12643
  hemagglutinin__InfluenzaA__AJI80507

SEQ ID NO: 12835 - protein, 566 aa, Artificial Sequence; identical to SEQ ID NO: 10040
  hemagglutinin__InfluenzaA__AJI80518

SEQ ID NO: 12836 - protein, 566 aa, Artificial Sequence; identical to SEQ ID NO: 8132
  hemagglutinin__InfluenzaA__AJJ98765

SEQ ID NO: 12837 - protein, 566 aa, Artificial Sequence
  hemagglutinin__InfluenzaA__AJJ98777
MKTIIALSYILCLVFAQKLPGNDNSTATLCLGHHAVPNGTIVKTITNDQIEVTNATELVQSFSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12838 - protein, 566 aa, Artificial Sequence; identical to SEQ ID NO: 9453
  hemagglutinin__InfluenzaA__AJJ98789

SEQ ID NO: 12839 - protein, 566 aa, Artificial Sequence
  hemagglutinin__InfluenzaA__AJJ98801
MKTIIALSYILCLVFAQKLPGNDNSTATLCLGHHAVPNGTIVKTITNDQIEVTNATELVQNSSIGEICDSPHQILDGENCTLIDALLGDPQCDGFQNKKWDLFVERNKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12840 - protein, 566 aa, Artificial Sequence
  hemagglutinin__InfluenzaA__AJJ98813
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVVPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12841 - protein, 566 aa, Artificial Sequence
  hemagglutinin__InfluenzaA__AJJ98825
MKTIIALSYILCLVFAQELPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQSSGRITVSTKRSQQAVIPNIGSRHRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12842 - protein, 566 aa, Artificial Sequence
  hemagglutinin__InfluenzaA__AJJ98837
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12843 - protein, 566 aa, Artificial Sequence
  hemagglutinin__InfluenzaA__AJJ98849
MKTIIALSYILCLVFAQELPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRLRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12844 - protein, 566 aa, Artificial Sequence
  hemagglutinin__InfluenzaA__AJJ98861
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12845 - protein, 566 aa, Artificial Sequence
  hemagglutinin__InfluenzaA__AJJ98873
MKTIIALSYSLCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRKSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12846 - protein, 566 aa, Artificial Sequence
  hemagglutinin__InfluenzaA__AJJ98885
MKTIIALSNILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNKEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12847 - protein, 566 aa, Artificial Sequence
  hemagglutinin__InfluenzaA__AJJ98897
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKVDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12848 - protein, 566 aa, Artificial Sequence; identical to SEQ ID NO: 11770
  hemagglutinin__InfluenzaA__AJJ98909

SEQ ID NO: 12849 - protein, 566 aa, Artificial Sequence
  hemagglutinin__InfluenzaA__AJJ98921
MKTIIALSYILCLVFAQKLPGKDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVKQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 12850 - protein, 566 aa, Artificial Sequence; identical to SEQ ID NO: 9453
  hemagglutinin__InfluenzaA__AJJ98933

SEQ ID NO: 12851 - protein, 566 aa, Artificial Sequence; identical to SEQ ID NO: 6982
  hemagglutinin__InfluenzaA__AJJ98945

SEQ ID NO: 12852 - protein, 566 aa, Artificial Sequence
  hemagglutinin__InfluenzaA__AJJ98957
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12853 - protein, 566 aa, Artificial Sequence; identical to SEQ ID NO: 2434
  hemagglutinin__InfluenzaA__AJJ98969

SEQ ID NO: 12854 - protein, 566 aa, Artificial Sequence
  hemagglutinin__InfluenzaA__AJJ98981
MKTIIALSYILCLVFAQKLPGNDNSTATLCLGHHAVPNGTIVKTITNDRIEVTNATELVQNSSIGEICDSPHHILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNVPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12855 - protein, 566 aa, Artificial Sequence
  hemagglutinin__InfluenzaA__AJJ98993
MKTIIALSYILCLVFAQKLPGNDNSTATLCLGHHAVPNGTIVKTITNDQIEVTNATELVQNSSIGEICDNPHQILDGENCTLIDALLGDPQCDGFQNKKWDLFVERSKAYSNCYPYDVPDYASLRSLVASSGTLEFNNESFNWTGVTQNGTSSACMRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12856 - protein, 566 aa, Artificial Sequence
  hemagglutinin__InfluenzaA__AJJ99005
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWIGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12857 - protein, 566 aa, Artificial Sequence; identical to SEQ ID NO: 3411
  hemagglutinin__InfluenzaA__AJJ99017

SEQ ID NO: 12858 - protein, 566 aa, Artificial Sequence
  hemagglutinin__InfluenzaA__AJJ99029
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFIERSKAYSNCYPYDVPDYASLRSLVASSGTLEFNNESFNWTGVTQNGTSSSCIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12859 - protein, 566 aa, Artificial Sequence
  hemagglutinin__InfluenzaA__AJJ99041
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRGSDNSFFSRLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSGCITPNGSIPNDKPFQNVNRITYGACPRYVKQSTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12860 - protein, 566 aa, Artificial Sequence; identical to SEQ ID NO: 9858
  hemagglutinin__InfluenzaA__AJJ99053

SEQ ID NO: 12861 - protein, 566 aa, Artificial Sequence; identical to SEQ ID NO: 9858
  hemagglutinin__InfluenzaA__AJJ99065

SEQ ID NO: 12862 - protein, 566 aa, Artificial Sequence
  hemagglutinin__InfluenzaA__AJJ99089
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERNKAYSNCYPYDVPDYASLRSLVASSGTLEFNNESFNWTGVTQNGTSSACIRRSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12863 - protein, 566 aa, Artificial Sequence; identical to SEQ ID NO: 9548
  hemagglutinin__InfluenzaA__AJJ99101

SEQ ID NO: 12864 - protein, 566 aa, Artificial Sequence; identical to SEQ ID NO: 9453
  hemagglutinin__InfluenzaA__AJJ99113

SEQ ID NO: 12865 - protein, 566 aa, Artificial Sequence
  hemagglutinin__InfluenzaA__AJJ99125
MKTIIALSYILCMVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSSNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12866 - protein, 566 aa, Artificial Sequence
  hemagglutinin__InfluenzaA__AJJ99137
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIVSIRNGTYDHDVYRDEALNNRFQIKGVELKSGYKDWILWISFAISCFLLCVALLGFIMWACQKGNIRCNICI

SEQ ID NO: 12867 - protein, 566 aa, Artificial Sequence
  hemagglutinin__InfluenzaA__AJJ99149
MKTIIALSYILCLVFAQKFPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDMPDYASLRSLVASSGTLEFNNESFNWTGVTQNGTSSACIRRSNSSFFSRLNWLTHLNFKYQALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12868 - protein, 566 aa, Artificial Sequence
  hemagglutinin__InfluenzaA__AJJ99161
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12869 - protein, 566 aa, Artificial Sequence
  hemagglutinin__InfluenzaA__AJJ99173
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFRIYHKCDNACIGSIRNGTYDHDVYRDEALNNRFQIKGVELKSGYKDWILWISFAISCFLLCVALLGFIMWACQKGNIRCNICI

SEQ ID NO: 12870 - protein, 566 aa, Artificial Sequence
  hemagglutinin__InfluenzaA__AJJ99185
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRKSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRADAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12871 - protein, 566 aa, Artificial Sequence; identical to SEQ ID NO: 8808
  hemagglutinin__InfluenzaA__AJJ99197

SEQ ID NO: 12872 - protein, 566 aa, Artificial Sequence
  hemagglutinin__InfluenzaA__AJJ99209
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSDNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAMSCFLLCVALLGFIMWACQKGNIRCNICI

SEQ ID NO: 12873 - protein, 566 aa, Artificial Sequence
  hemagglutinin__InfluenzaA__AJJ99221
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12874 - protein, 566 aa, Artificial Sequence; identical to SEQ ID NO: 1915
  hemagglutinin__InfluenzaA__AJJ99233

SEQ ID NO: 12875 - protein, 566 aa, Artificial Sequence
  hemagglutinin__InfluenzaA__AJJ99244
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12876 - protein, 566 aa, Artificial Sequence
  hemagglutinin__InfluenzaA__AJJ99255
MKAILVVLLYTFATANADTLCIGYHANNSTDTVDTVLEKNVTVTHSVNLLEDNHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPRAGAKSFYKNLIWLVKKGNSYPKLSKSYINDKGKEVLVMWGIHHPSTTADQQSLYQNADAYVFVGTSRYSKEFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12877 - protein, 565 aa, Artificial Sequence
  hemagglutinin__InfluenzaA__AJJ99267
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTITGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAVSFWMCSNGSLQCRVCI

SEQ ID NO: 12878 - protein, 566 aa, Artificial Sequence; identical to SEQ ID NO: 7050
  hemagglutinin__InfluenzaA__AJJ99278

SEQ ID NO: 12879 - protein, 566 aa, Artificial Sequence; identical to SEQ ID NO: 7053
  hemagglutinin__InfluenzaA__AJJ99289

SEQ ID NO: 12880 - protein, 565 aa, Artificial Sequence
  hemagglutinin__InfluenzaA__AJJ99301
MKVKLLVLLCTFTATYADTICIGYHANNSTDTVDTVLEKNVTVTHSVNLLENSHNGKLCLLKGIAPLQLGNCSVAGWILGNPECESLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12881 - protein, 565 aa, Artificial Sequence
  hemagglutinin__InfluenzaA__AJJ99324
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKSGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12882 - protein, 566 aa, Artificial Sequence
  hemagglutinin__InfluenzaA__AJJ99335
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSNNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPNGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12883 - protein, 566 aa, Artificial Sequence; identical to SEQ ID NO: 4785
  hemagglutinin__InfluenzaA__AJJ99357

SEQ ID NO: 12884 - protein, 566 aa, Artificial Sequence; identical to SEQ ID NO: 6824
  hemagglutinin__InfluenzaA__AJJ99368

SEQ ID NO: 12885 - protein, 566 aa, Artificial Sequence; identical to SEQ ID NO: 6435
  hemagglutinin__InfluenzaA__AJJ99379

SEQ ID NO: 12886 - protein, 566 aa, Artificial Sequence
  hemagglutinin__InfluenzaA__AJJ99390
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12887 - protein, 566 aa, Artificial Sequence; identical to SEQ ID NO: 4785
  hemagglutinin__InfluenzaA__AJJ99401

SEQ ID NO: 12888 - protein, 565 aa, Artificial Sequence
  hemagglutinin__InfluenzaA__AJJ99413
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNASMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12889 - protein, 565 aa, Artificial Sequence; identical to SEQ ID NO: 3626
  hemagglutinin__InfluenzaA__AJJ99425

SEQ ID NO: 12890 - protein, 565 aa, Artificial Sequence
  hemagglutinin__InfluenzaA__AJJ99437
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPSLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12891 - protein, 565 aa, Artificial Sequence
  hemagglutinin__InfluenzaA__AJJ99449
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSKESKLNREKIDGVKLESMGVYQILAIYSTVASSLVLLVSLGAISFWMCSNGSLQCRICI

SEQ ID NO: 12892 - protein, 565 aa, Artificial Sequence; identical to SEQ ID NO: 2488
  hemagglutinin__InfluenzaA__AJJ99461

SEQ ID NO: 12893 - protein, 566 aa, Artificial Sequence
  hemagglutinin__InfluenzaA__AJJ99483
MKAILLVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPRAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12894 - protein, 566 aa, Artificial Sequence; identical to SEQ ID NO: 7053
  hemagglutinin__InfluenzaA__AJJ99494

SEQ ID NO: 12895 - protein, 566 aa, Artificial Sequence
  hemagglutinin__InfluenzaA__AJJ99505
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKGFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12896 - protein, 566 aa, Artificial Sequence; identical to SEQ ID NO: 2911
  hemagglutinin__InfluenzaA__AJJ99516

SEQ ID NO: 12897 - protein, 566 aa, Artificial Sequence
  hemagglutinin__InfluenzaA__AJJ99527
MKAILLVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPRAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNVIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12898 - protein, 566 aa, Artificial Sequence
  hemagglutinin__InfluenzaA__AJJ99538
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12899 - protein, 566 aa, Artificial Sequence
  hemagglutinin__InfluenzaA__AJJ99549
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNMCMESVKNGTYDYPKYSEEAKLNREEIDGVKLESTRIYQILAIYSTAASSLVLVVSLGAISFWMCSNGSLQCRICI

SEQ ID NO: 12900 - protein, 566 aa, Artificial Sequence; identical to SEQ ID NO: 7089
  hemagglutinin__InfluenzaA__AJJ99560

SEQ ID NO: 12901 - protein, 566 aa, Artificial Sequence
  hemagglutinin__InfluenzaA__AJJ99571
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNIQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12902 - protein, 566 aa, Artificial Sequence
  hemagglutinin__InfluenzaA__AJJ99582
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPNGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12903 - protein, 566 aa, Artificial Sequence; identical to SEQ ID NO: 2911
  hemagglutinin__InfluenzaA__AJJ99593

SEQ ID NO: 12904 - protein, 566 aa, Artificial Sequence
  hemagglutinin__InfluenzaA__AJJ99604
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPRVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12905 - protein, 565 aa, Artificial Sequence
  hemagglutinin__InfluenzaA__AJJ99616
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIANQKTLYHTENAYVSVVSSHYSRKLTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12906 - protein, 565 aa, Artificial Sequence; identical to SEQ ID NO: 3626
  hemagglutinin__InfluenzaA__AJJ99628

SEQ ID NO: 12907 - protein, 565 aa, Artificial Sequence
  hemagglutinin__InfluenzaA__AJJ99640
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIANQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAVAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12908 - protein, 565 aa, Artificial Sequence; identical to SEQ ID NO: 3626
  hemagglutinin__InfluenzaA__AJJ99652

SEQ ID NO: 12909 - protein, 565 aa, Artificial Sequence
  hemagglutinin__InfluenzaA__AJJ99664
MKAKLLVLLCTFTATYADTICIGYHANNSTDTVDTVLEKNVTVTHSVNLLENSHNGKLCLLKGIAPLQLGNCSIAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12910 - protein, 566 aa, Artificial Sequence
  hemagglutinin__InfluenzaA__AJJ99675
MKAILLVLLYTFATAKADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPRAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITDKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12911 - protein, 566 aa, Artificial Sequence
  hemagglutinin__InfluenzaA__AJJ99686
MTAILLVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPRAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12912 - protein, 566 aa, Artificial Sequence
  hemagglutinin__InfluenzaA__AJJ99697
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFVMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12913 - protein, 566 aa, Artificial Sequence
  hemagglutinin__InfluenzaA__AJJ99708
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFVMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12914 - protein, 566 aa, Artificial Sequence
  hemagglutinin__InfluenzaA__AJJ99719
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIEGVKLESTRIYQILAIYSTVASSLVLVVSLGAISFWMCSNGSLQCRICI

SEQ ID NO: 12915 - protein, 566 aa, Artificial Sequence
  hemagglutinin__InfluenzaA__AJJ99730
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLIEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFHHKCDNTCMESVKNGTYDYPKYSEEAKLNREEIDGVKLESTRIYQILAIYSTVASSLVLVVSLGAISFWMCSNGSLQCRICI

SEQ ID NO: 12916 - protein, 566 aa, Artificial Sequence; identical to SEQ ID NO: 7042
  hemagglutinin__InfluenzaA__AJJ99741

SEQ ID NO: 12917 - protein, 566 aa, Artificial Sequence; identical to SEQ ID NO: 3833
  hemagglutinin__InfluenzaA__AJJ99752

SEQ ID NO: 12918 - protein, 566 aa, Artificial Sequence; identical to SEQ ID NO: 2669
  hemagglutinin__InfluenzaA__AJJ99763

SEQ ID NO: 12919 - protein, 565 aa, Artificial Sequence
  hemagglutinin__InfluenzaA__AJJ99775
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPTDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12920 - protein, 566 aa, Artificial Sequence
  hemagglutinin__InfluenzaA__AJJ99786
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSAVASSLVLVVSLGAISFWMCSNGSLQCRICI

SEQ ID NO: 12921 - protein, 565 aa, Artificial Sequence
  hemagglutinin__InfluenzaA__AJJ99798
MKVKLLVLLCTFTATYADTICIGYHANNSTDTVDTVLEKNVTVTHSVNLLENSHNGKLCLLKGIAPLQLGNCSVAGWILGNPECELLISKESWSYIVERPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIANQKTLYHTENAYVSVVSSHYSRKFTPEIAKRPKVRDQEGRINYYWTLLEPGDTIMFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12922 - protein, 565 aa, Artificial Sequence; identical to SEQ ID NO: 2488
  hemagglutinin__InfluenzaA__AJJ99810

SEQ ID NO: 12923 - protein, 565 aa, Artificial Sequence
  hemagglutinin__InfluenzaA__AJJ99822
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPFIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12924 - protein, 566 aa, Artificial Sequence
  hemagglutinin__InfluenzaA__AJJ99833
MKAILLVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPRAGAKSFYKNLIWLVKKGNSYLKLSKSYINDKGKEVLVLWGIHHPSTTADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12925 - protein, 566 aa, Artificial Sequence; identical to SEQ ID NO: 6824
  hemagglutinin__InfluenzaA__AJJ99844

SEQ ID NO: 12926 - protein, 566 aa, Artificial Sequence
  hemagglutinin__InfluenzaA__AJJ99855
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDSTCMESVKNGTYDYPKYSEEAKLNREEIDGVKLESTRIYQILAIYSTVASSLVLVVSLGAISFWMCSNGSLQCRICI

SEQ ID NO: 12927 - protein, 566 aa, Artificial Sequence
  hemagglutinin__InfluenzaA__AJJ99866
MKAILVVLLYTFATANADTLCIGYHANNSTDTVDTVLEKNVTVTHSVNLLEDKHNGKLCKLKGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12928 - protein, 566 aa, Artificial Sequence
  hemagglutinin__InfluenzaA__AJJ99877
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVRNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12929 - protein, 566 aa, Artificial Sequence
  hemagglutinin__InfluenzaA__AJJ99888
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12930 - protein, 566 aa, Artificial Sequence
  hemagglutinin__InfluenzaA__AJJ99899
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPRAGAKSFYKNLIWLVKKGNSYPNLSKSYINDKGKEVLVLWGIHHPSTTADQQSLYQNADAYVFVGTSRYSKKFKPEIAIRPKVRDQEGRMNYYWTLLEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNGQGSGYAADLKSTQNAVDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12931 - protein, 566 aa, Artificial Sequence
  hemagglutinin__InfluenzaA__AJJ99910
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12932 - protein, 566 aa, Artificial Sequence; identical to SEQ ID NO: 6824
  hemagglutinin__InfluenzaA__AJJ99921

SEQ ID NO: 12933 - protein, 566 aa, Artificial Sequence
  hemagglutinin__InfluenzaA__AJJ99932
MKAILVVLLYTFATANADTLCIGYHANNSTDTVDTVLEKNVTVTHSVNLLEDKHNGKLCKLRGVAPLHLGKCDIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12934 - protein, 566 aa, Artificial Sequence; identical to SEQ ID NO: 6454
  hemagglutinin__InfluenzaA__AJJ99943

SEQ ID NO: 12935 - protein, 566 aa, Artificial Sequence
  hemagglutinin__InfluenzaA__AJJ99954
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFEKFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIITSDTPVHDCNTTCQTPKGAINTSLPFQNIHPITIGNCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12936 - protein, 566 aa, Artificial Sequence; identical to SEQ ID NO: 2911
  hemagglutinin__InfluenzaA__AJJ99965

SEQ ID NO: 12937 - protein, 565 aa, Artificial Sequence
  hemagglutinin__InfluenzaA__AJJ99989
MKVKLLVLLCTFTATYADTICIGYHANNSTDTVDTVLERNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSKKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQRSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12938 - protein, 566 aa, Artificial Sequence
  hemagglutinin__InfluenzaA__AJK00001
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPRAGEKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12939 - protein, 566 aa, Artificial Sequence
  hemagglutinin__InfluenzaA__AJK00012
MKAILVVLLCTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTTVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGDGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12940 - protein, 566 aa, Artificial Sequence
  hemagglutinin__InfluenzaA__AJK00023
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPRAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12941 - protein, 566 aa, Artificial Sequence; identical to SEQ ID NO: 6824
  hemagglutinin__InfluenzaA__AJK00034

SEQ ID NO: 12942 - protein, 566 aa, Artificial Sequence; identical to SEQ ID NO: 7042
  hemagglutinin__InfluenzaA__AJK00045

SEQ ID NO: 12943 - protein, 566 aa, Artificial Sequence; identical to SEQ ID NO: 7042
  hemagglutinin__InfluenzaA__AJK00056

SEQ ID NO: 12944 - protein, 566 aa, Artificial Sequence; identical to SEQ ID NO: 2911
  hemagglutinin__InfluenzaA__AJK00067

SEQ ID NO: 12945 - protein, 565 aa, Artificial Sequence
  hemagglutinin__InfluenzaA__AJK00079
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTRKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 12946 - protein, 565 aa, Artificial Sequence
  hemagglutinin__InfluenzaA__AJK00091
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTITGVSASCSHNGESSFYRNLLWLTGKNGLYPNLSKSYANNKEKEVLVLWGVHHPPNIGVQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAVSFWMCSNGSLQCRVCI

SEQ ID NO: 12947 - protein, 565 aa, Artificial Sequence; identical to SEQ ID NO: 2488
  hemagglutinin__InfluenzaA__AJK00103

SEQ ID NO: 12948 - protein, 566 aa, Artificial Sequence; identical to SEQ ID NO: 6920
  hemagglutinin__InfluenzaA__AJK00114

SEQ ID NO: 12949 - protein, 566 aa, Artificial Sequence
  hemagglutinin__InfluenzaA__AJK00125
MKAILVVLLYTFATANADTLCIGYHANNSTDTVDTVLEKNVTVTHSVNLLEDKHNGKLCKLREVAPLHLGKCNIAGWILGNPECESLSTASSWSYIVETSSSDNGTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVYDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 12950 - protein, 566 aa, Artificial Sequence; identical to SEQ ID NO: 2669
  hemagglutinin__InfluenzaA__AJK00136

SEQ ID NO: 12951 - protein, 567 aa, Artificial Sequence
  hemagglutinin__InfluenzaA__AJK00166
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGKPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 12952 - protein, 568 aa, Artificial Sequence
  hemagglutinin__InfluenzaA__AJK00177
MEKIVLLLAVVSLVRSDQICIGYHANNSTEQVDTIMEKNVTVTHAQDILEKTHNGKLCDLDGVKPLILRDCSVAGWLLGNPMCDEFINVPEWSYIVEKANPANDLCYPGNLNDYEELKHLLSRINHFEKIQIIPKSSWSDHEASLGVSSACPYQGTPSFFRNVVWLIKKNNTYPTIKRSYNNTNQEDLLILWGIHHSNDEAEQIKLYQNPTTYVSVGTSTLNQRLVPKIATRSKVNGQSGRMDFFWTILKPDDAINFESNGNFIAPEYAYKIVKKGDSAIMKSEVEYGNCNTKCQTPIGAINSSMPFHNIHPLTIGECPKYVKSNKLVLATGLRNSPLREKRRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 12953 - protein, 567 aa, Artificial Sequence
  hemagglutinin__InfluenzaA__AJK00188
MEKIVLLLAVVSLVRSDQICIGYHANNSTEQVDTIMEKNVTVTHAQDILEKTHNGKLCDLDGVKPLILRDCSVAGWLLGNPMCDEFINVPEWSYIVEKANPANDLCYPGNLNDYEELKHLLSRINHFEKIQIIPKSSWSDHEASLGVSSACPYQGTPSFFRNVVWLIKKNNTYPTIKRSYNNTNQEDLLILWGIHHSNDEAEQIKLYQNPTTYISVGTSTLNQRLVPKIATRSKVNGQSGRMDFFWTILKPDDAINFESNGNFIAPEYAYKIVKKGDSAIMKSEVEYGNCNTKCQTPIGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 12954 - protein, 567 aa, Artificial Sequence
  hemagglutinin__InfluenzaA__AJK00207
MEKIVLLLAIVSLVRSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTSQEDLLVLWGIHHSNDATEQMKLYQNPTTYVSVGTSTLNQRLVPKIATRSKVNGQSGRMDFFWTILKSNDAINFESNGNFIAPEYAYKIVKKGDSAIMKSEVEYGNCSTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNTKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 12955 - protein, 567 aa, Artificial Sequence
  hemagglutinin__InfluenzaA__AJK00218
MEKIVLFLAIVSLVRSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIRIIPKSSWPDHEASSGVSSACPYQGTPSFFRNIVWLIKKNNTYPTIKRSYNNTSQEDLLVLWGIHHSSDATEQIKLYQNPTTYVSVGTSTLNQRLVPKIATRSKVNGQSGRMDFFWTILKSNDAINFESNGNFIAPEYAYKIVKKGDSAIMKSEVEYGNCSTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTAASSLALAIMVAGLSLWMCSNGSLQCRICI

SEQ ID NO: 12956 - protein, 567 aa, Artificial Sequence
  hemagglutinin__InfluenzaA__AJK00239
MEKIVLLLAIVSLVRSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTSQEDLLVLWGIHHSNDATEQMKLYQNPTTYVSVGTSTLNQRLVPKIATRSKVNGQSGRMDFFWTILKSNDAINFESNGNFIAPEYAYKIVKKGDSAIMKSEVEYGNCSTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 12957 - protein, 567 aa, Artificial Sequence
  hemagglutinin__InfluenzaA__AJS18468
MEKIVLLLAVVSLVKSDQICIGYHANNSTEQVDTIMEKNVTVTHAQDILEKTHNGRLCDLNGVKPLILKDCSVAGWLLGNPMCDEFIRVPEWSYIVERANPANDLCYPGNLNDYEELKHLLSRINHFEKTLIIPKSSWPNHETSLGVSAACPYQGVPSFFRNVVWLTKKNDAYPTIKMSYNNTNREDLLILWGIHHSNNAAEQTNLYKNPTTYVSVGTSTLNQRLVPKIATRSQVNGQRGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLRERRRKRGLFGAIAGFIEGGWQGMVDGWYGYHHSNEQGSGYAADRESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLTLAIIVAGLSLWMCSNGSLQCRICI

SEQ ID NO: 12958 - protein, 567 aa, Artificial Sequence
  hemagglutinin__InfluenzaA__AJS18479
MEKIVLLLAVVSLVKSDQICIGYHANNSTEQVDTIMEKNVTVTHAQDILEKTHNGRLCDLNGVKPLILKDCSVAGWLLGNPMCDEFIRVPEWSYIVERANPANDLCYPGNLNDYEELKHLLSRINHFEKTLIIPKSSWPNHETSLGVSAACPYQGMPSFFRNVVWLTKKNDTYPTIKMSYNNTNREDLLILWGIHHSNNAAEQTNLYKNPTTYVSVGTATLNQRLVPKIATRSQVNGQRGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLRERRRKRGLFGAIAGFIEGGWQGMVDGWYGYHHSNEQGSGYAADRESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIIVAGLSLWMCSNGSLQCRICI

SEQ ID NO: 12959 - protein, 567 aa, Artificial Sequence
  hemagglutinin__InfluenzaA__AJY79339
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNLNDYEELKHLLSRINHFEKIQIIPKDSWSDHEASGVSSACPYQGRSSFFRNVVWLTKKNDAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGEKRRKKRGLFGAIAGFIEGGWQGMVDGWYGYHHSNEQGSGYAADKESTQRAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 12960 - protein, 567 aa, Artificial Sequence
  hemagglutinin__InfluenzaA__AJY79341
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKDSWSDHETSGVSSACPYQGRSSFFRNVVWLTKKNDAYPTIKKSYNNTNQEDLLVLWGIHHPNDAAEQTRLYQNPTTYISVGTSTLNQRLVPKIATRSKVNGQNGRMEFFWTILKSNDAINFESNGNFIAPENAYKIVKKGDSTIMRSELEYSNCNTKCQTPIGAINSSMPFHNIHPLTIGECPKYVKSNRLVLATGLRNSPQGEKRRKKRGLFGAIAGFIEGGWQGMVDGWYGYHHSNEQGSGYAADKESTQRAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 12961 - protein, 567 aa, Artificial Sequence
  hemagglutinin__InfluenzaA__AJY79342
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKDSWSDHEASGVSSACPYQGRSSFFRNVVWLTKKNDAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGEKRRKKRGLFGAIAGFIEGGWQGMVDGWYGYHHSNEQGSGYAADKESTQRAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 12962 - protein, 567 aa, Artificial Sequence
  hemagglutinin__InfluenzaA__AJY79343
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKDSWSDHEASGVSSACPYQGRSSFFRNVVWLTKKNDAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGEKRRKKRGLFGAIAGFIEGGWQGMVDGWYGYHHSNEQGSGYAADKESTQRAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDDECMESVRNGTYDYPQYSEEARLKREEISGVKLESIGTYQILSIYSTVASSLALAIMVAGLSLWMCSNGSLQCRICI

SEQ ID NO: 12963 - protein, 567 aa, Artificial Sequence
  hemagglutinin__InfluenzaA__AJY79345
MEKIVLLLAIVSIVKSDQICIGYHANNSTEQVDTIMEKNVTVTRAQDILEKTHNGKLCNLDGVKPLILRDCSVAGWLLGNPMCDEFLNVPEWSYIVEKINPANDLCYPGNFNDYEELKHLLSRINHFEKIQIIPKDSWSDHEASGVSSACPYQGRSSFFRNVVWLTKKNDAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGEKRRKKRGLFGAIAGFIEGGWQGMVDGWYGYHHSNEQGSGYAADKESTQRAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 12964 - protein, 566 aa, Artificial Sequence; identical to SEQ ID NO: 12441
  hemagglutinin__InfluenzaA__AKA54643

SEQ ID NO: 12965 - protein, 566 aa, Artificial Sequence
  hemagglutinin__InfluenzaA__AKA54650
MKTIIALSYILCLVFTQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12966 - protein, 566 aa, Artificial Sequence
  hemagglutinin__InfluenzaA__AKA54651
MKTIIAFSCILCQISAQKLPGSDNSMATLCLGHHAVPNGTLVKTITDDQIEVTNATELVQSTSKGEICSSPHQILDGKNCTLIDALLGDPHCDDFQNKKWDLFVERSTAYSNCYPYYVPDYASLRSLVASSGTLEFTQESFNWTGVAQDGASYSCRRESENSFFSRLNWLYSLNYKYPALNVTMPNNDKFDKLYIWGVHHPGTDKDQTSLYIQASGRVTVSTKWSQQTVIPNIGSRPWIRGVSSIISIYWTIVKPGDILLINSTGNLIAPRGYFKIQSGKSSIMRSDAHIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLERYVEDTKIDLWSYNAELLVALENQHTIDLTDSEMNKLFERTRKQLRENAEDMGNGCFKIYHKCDNACIGSIRNGTYDHDVYRDEAVNNRFQIKGVQLKLGYKDWILWISFAISCFLLCAVLLGFIMWACQKGNIRCNICI

SEQ ID NO: 12967 - protein, 566 aa, Artificial Sequence
  hemagglutinin__InfluenzaA__AKA59351
MKAILVILLYTFAAANADTICIGYHANNSTDTVDTVLEKNVTVTHSVDLLEDKHNGRLCKLRGVAPLHLGKCNIAGWILGNPECESLSTASSWSYIVETSSSDNGTCYPGDFIDYEELREQLSSVSSFERFEIFPKTSSWPNHESNKGVTAACPQAGAKSFYKNLIWLVKKENSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12968 - protein, 566 aa, Artificial Sequence
  hemagglutinin__InfluenzaA__AKA59353
MKAILVVLLYTFATANADTLCIGYHANNSTDTVDTVLEKNVTVTHSVNLLEDKHNGKLCKLRGVAPLHLGECNIAGWILGNPECESLSTASSWSYIVETPSSNNGTCYPGDFIDYEELREQLSSVSSFERFEIFPNTSSWPNHDSSKGVTAACPHAGAKSFYKNLIWLVKKGNSYPKLSKSYINDKGKEVLVLWGIHHPSTSADQQKLYQNEDAYVFVGTSRYSKKFKPEIAIRPKVRDQEGRMNYYWTLVEPGDKITFEATGNIVVPRYAFAMERNAGSGIIISDTPVHNCNTTCQTPKGAINTSLPFQNVHPITIGKCPKYVKSTKLRLATGLRNVPSIQSRGLFGAIAGFIEGGWTGMVDGWYGYHHQNEQGSGFAADLKSTQNAIDGITNKVNSVIEKMNTQFTAVGKEFNHLEKRIENLNRKIDDGFLDIWTYNAELLILLENERTLDYHDSNVRNLYEKVRSQLKNNAKEIGNGCFEFYHKCDNTCMESVKNGTYDYPKYSEEAKLNREEIDGVKLESTRIYQILAIYSTVASSLVLIVSLGAISFWMCSNGSLQCRICI

SEQ ID NO: 12969 - protein, 566 aa, Artificial Sequence
  hemagglutinin__InfluenzaA__AKA59355
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGARSFYKNLIWLVKKGNSYPKLNQSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNLVIEKMNTQFTAVGKEFSHLEKRIENLNKKVDDGFLDIWTYNAELLVLLENERTLDYHDSNVKNLYEKIRSQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 12970 - protein, 566 aa, Artificial Sequence
  hemagglutinin__InfluenzaA__AKE37137
MKARLVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSTSYINDKGKEVLVLWGIHHPSTSADQQSLYQNADAYAFVGTSRYSKKFKPEIAIRPKVRDREGRMNYYWTLVEPGDKITFEATGNLVVPRYAFAMERNAGSGIIISDTSVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAFDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12971 - protein, 566 aa, Artificial Sequence
  hemagglutinin__InfluenzaA__AKS48035
MEKMVLLLAVVSLVKSDQICIGYHANNSTEQVDTIMEKNVTVTHAQDILEKTHNGRLCDLNGVKPLILKDCSVAGWLLGNPMCDEFIRVPEWSYIVERANPANDLCYPGNLNDYEELKHLLSRINHFEKTLIIPKSSWPNHTSSGVSAACPYQGMPSFFRNVVWLTKKNDAYPTIKMSYNNTYREDLLILWGIHHSNNAAEQTNLYKNPTTYVSVGTSTLNQRLEPKIATRSQVNGQRGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLRERRRKRGLFGAIAGFIEGGWQGMVDGWYGYHHSNEQGSGYAADRESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIIVAGLSLWMCSNGSLQCRICI

SEQ ID NO: 12972 - protein, 566 aa, Artificial Sequence
  hemagglutinin__InfluenzaA__ALA08472
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYVWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12973 - protein, 566 aa, Artificial Sequence; identical to SEQ ID NO: 12441
  hemagglutinin__InfluenzaA__ALA08475

SEQ ID NO: 12974 - protein, 566 aa, Artificial Sequence
  hemagglutinin__InfluenzaA__ALA08478
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKRWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIQSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12975 - protein, 566 aa, Artificial Sequence; identical to SEQ ID NO: 9994
  hemagglutinin__InfluenzaA__ALA08479

SEQ ID NO: 12976 - protein, 566 aa, Artificial Sequence
  hemagglutinin__InfluenzaA__ALA08481
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAHSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12977 - protein, 566 aa, Artificial Sequence; identical to SEQ ID NO: 12976
  hemagglutinin__InfluenzaA__ALA08482

SEQ ID NO: 12978 - protein, 566 aa, Artificial Sequence
  hemagglutinin__InfluenzaA__ALA08483
MKTIIGLSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12979 - protein, 566 aa, Artificial Sequence
  hemagglutinin__InfluenzaA__ALA08484
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITISTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12980 - protein, 566 aa, Artificial Sequence
  hemagglutinin__InfluenzaA__ALA08488
MKTIIALSYILCLVFAQKIPGNGNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12981 - protein, 566 aa, Artificial Sequence
  hemagglutinin__InfluenzaA__ALA08490
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGIELKSGYKDWILWISFAISCFLLCVALLGFIMWACQKGNIRCNICI

SEQ ID NO: 12982 - protein, 566 aa, Artificial Sequence
  hemagglutinin__InfluenzaA__ALA08491
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNMTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12983 - protein, 566 aa, Artificial Sequence; identical to SEQ ID NO: 12981
  hemagglutinin__InfluenzaA__ALA08492

SEQ ID NO: 12984 - protein, 566 aa, Artificial Sequence
  hemagglutinin__InfluenzaA__ALA08493
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCRSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGIELKSGYKDWILWISFAISCFLLCVALLGFIMWACQKGNIRCNICI

SEQ ID NO: 12985 - protein, 566 aa, Artificial Sequence
  hemagglutinin__InfluenzaA__ALA08494
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 12986 - protein, 566 aa, Artificial Sequence; identical to SEQ ID NO: 12985
  hemagglutinin__InfluenzaA__ALA08495

SEQ ID NO: 12987 - protein, 566 aa, Artificial Sequence; identical to SEQ ID NO: 12985
  hemagglutinin__InfluenzaA__ALA08496

SEQ ID NO: 12988 - protein, 566 aa, Artificial Sequence; identical to SEQ ID NO: 12441
  hemagglutinin__InfluenzaA__ALA08497

SEQ ID NO: 12989 - protein, 566 aa, Artificial Sequence; identical to SEQ ID NO: 12441
  hemagglutinin__InfluenzaA__ALA08498

SEQ ID NO: 12990 - protein, 566 aa, Artificial Sequence
  hemagglutinin__InfluenzaA__ALA08499
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKVDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12991 - protein, 566 aa, Artificial Sequence; identical to SEQ ID NO: 12974
  hemagglutinin__InfluenzaA__ALA08501

SEQ ID NO: 12992 - protein, 566 aa, Artificial Sequence
  hemagglutinin__InfluenzaA__ALA08502
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKVDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12993 - protein, 566 aa, Artificial Sequence; identical to SEQ ID NO: 12992
  hemagglutinin__InfluenzaA__ALA08503

SEQ ID NO: 12994 - protein, 566 aa, Artificial Sequence; identical to SEQ ID NO: 12441
  hemagglutinin__InfluenzaA__ALA08504

SEQ ID NO: 12995 - protein, 566 aa, Artificial Sequence; identical to SEQ ID NO: 12441
  hemagglutinin__InfluenzaA__ALA08505

SEQ ID NO: 12996 - protein, 566 aa, Artificial Sequence; identical to SEQ ID NO: 12441
  hemagglutinin__InfluenzaA__ALA08506

SEQ ID NO: 12997 - protein, 566 aa, Artificial Sequence; identical to SEQ ID NO: 12441
  hemagglutinin__InfluenzaA__ALA08507

SEQ ID NO: 12998 - protein, 566 aa, Artificial Sequence
  hemagglutinin__InfluenzaA__ALA08508
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 12999 - protein, 566 aa, Artificial Sequence; identical to SEQ ID NO: 12441
  hemagglutinin__InfluenzaA__ALA08509

SEQ ID NO: 13000 - protein, 566 aa, Artificial Sequence; identical to SEQ ID NO: 12441
  hemagglutinin__InfluenzaA__ALA08510

SEQ ID NO: 13001 - protein, 566 aa, Artificial Sequence
  hemagglutinin__InfluenzaA__ALA08511
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSSCIRRSSSSFFSRLNWLTHLNYTYPALNVTMPNNEQFDKLYIWGVHHPSTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13002 - protein, 566 aa, Artificial Sequence; identical to SEQ ID NO: 12441
  hemagglutinin__InfluenzaA__ALA08512

SEQ ID NO: 13003 - protein, 566 aa, Artificial Sequence; identical to SEQ ID NO: 12441
  hemagglutinin__InfluenzaA__ALA08514

SEQ ID NO: 13004 - protein, 566 aa, Artificial Sequence; identical to SEQ ID NO: 12441
  hemagglutinin__InfluenzaA__ALA08515

SEQ ID NO: 13005 - protein, 566 aa, Artificial Sequence; identical to SEQ ID NO: 12441
  hemagglutinin__InfluenzaA__ALA08516

SEQ ID NO: 13006 - protein, 566 aa, Artificial Sequence; identical to SEQ ID NO: 12998
  hemagglutinin__InfluenzaA__ALA08517

SEQ ID NO: 13007 - protein, 566 aa, Artificial Sequence; identical to SEQ ID NO: 12441
  hemagglutinin__InfluenzaA__ALA08519

SEQ ID NO: 13008 - protein, 566 aa, Artificial Sequence
  hemagglutinin__InfluenzaA__ALA08520
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQPSGRITVSTKRSQQAVIPNIGSRPRIRDIPSRISIYWTIVKPGDILLINSTGNLIAPRGYFKIRNGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13009 - protein, 566 aa, Artificial Sequence; identical to SEQ ID NO: 10138
  hemagglutinin__InfluenzaA__ALA08522

SEQ ID NO: 13010 - protein, 566 aa, Artificial Sequence
  hemagglutinin__InfluenzaA__ALA08523
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSIGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13011 - protein, 566 aa, Artificial Sequence
  hemagglutinin__InfluenzaA__ALA08524
MKTIIALSYILCMVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRLRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13012 - protein, 566 aa, Artificial Sequence; identical to SEQ ID NO: 12441
  hemagglutinin__InfluenzaA__ALA08525

SEQ ID NO: 13013 - protein, 566 aa, Artificial Sequence; identical to SEQ ID NO: 12441
  hemagglutinin__InfluenzaA__ALA08526

SEQ ID NO: 13014 - protein, 566 aa, Artificial Sequence; identical to SEQ ID NO: 12998
  hemagglutinin__InfluenzaA__ALA08527

SEQ ID NO: 13015 - protein, 566 aa, Artificial Sequence
  hemagglutinin__InfluenzaA__ALA08528
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIYLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQMRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13016 - protein, 566 aa, Artificial Sequence; identical to SEQ ID NO: 12441
  hemagglutinin__InfluenzaA__ALA08529

SEQ ID NO: 13017 - protein, 566 aa, Artificial Sequence; identical to SEQ ID NO: 12441
  hemagglutinin__InfluenzaA__ALA08530

SEQ ID NO: 13018 - protein, 566 aa, Artificial Sequence
  hemagglutinin__InfluenzaA__ALA08531
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 13019 - protein, 566 aa, Artificial Sequence; identical to SEQ ID NO: 12441
  hemagglutinin__InfluenzaA__ALA08532

SEQ ID NO: 13020 - protein, 566 aa, Artificial Sequence; identical to SEQ ID NO: 12441
  hemagglutinin__InfluenzaA__ALA08533

SEQ ID NO: 13021 - protein, 566 aa, Artificial Sequence; identical to SEQ ID NO: 12441
  hemagglutinin__InfluenzaA__ALA08534

SEQ ID NO: 13022 - protein, 566 aa, Artificial Sequence; identical to SEQ ID NO: 12441
  hemagglutinin__InfluenzaA__ALA08535

SEQ ID NO: 13023 - protein, 566 aa, Artificial Sequence; identical to SEQ ID NO: 12998
  hemagglutinin__InfluenzaA__ALA08536

SEQ ID NO: 13024 - protein, 566 aa, Artificial Sequence; identical to SEQ ID NO: 12998
  hemagglutinin__InfluenzaA__ALA08537

SEQ ID NO: 13025 - protein, 566 aa, Artificial Sequence; identical to SEQ ID NO: 12998
  hemagglutinin__InfluenzaA__ALA08538

SEQ ID NO: 13026 - protein, 566 aa, Artificial Sequence; identical to SEQ ID NO: 12441
  hemagglutinin__InfluenzaA__ALA08539

SEQ ID NO: 13027 - protein, 566 aa, Artificial Sequence; identical to SEQ ID NO: 12998
  hemagglutinin__InfluenzaA__ALA08540

SEQ ID NO: 13028 - protein, 566 aa, Artificial Sequence; identical to SEQ ID NO: 12998
  hemagglutinin__InfluenzaA__ALA08541

SEQ ID NO: 13029 - protein, 566 aa, Artificial Sequence; identical to SEQ ID NO: 12998
  hemagglutinin__InfluenzaA__ALA08542

SEQ ID NO: 13030 - protein, 566 aa, Artificial Sequence
  hemagglutinin__InfluenzaA__ALA08543
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAAIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13031 - protein, 566 aa, Artificial Sequence; identical to SEQ ID NO: 12441
  hemagglutinin__InfluenzaA__ALA08545

SEQ ID NO: 13032 - protein, 566 aa, Artificial Sequence; identical to SEQ ID NO: 12441
  hemagglutinin__InfluenzaA__ALA08546

SEQ ID NO: 13033 - protein, 566 aa, Artificial Sequence
  hemagglutinin__InfluenzaA__ALA08548
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVAQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13034 - protein, 566 aa, Artificial Sequence
  hemagglutinin__InfluenzaA__ALA08549
MKTIIALSYILCLVFAQKIPGNDNSTATLCLGHHAVPNGTIVKTITNDRIEVTNATELVQNSSTGVICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13035 - protein, 566 aa, Artificial Sequence; identical to SEQ ID NO: 12998
  hemagglutinin__InfluenzaA__ALA08550

SEQ ID NO: 13036 - protein, 566 aa, Artificial Sequence
  hemagglutinin__InfluenzaA__ALA08551
MKTIIALSYILCLVFAQKLLENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13037 - protein, 566 aa, Artificial Sequence; identical to SEQ ID NO: 12998
  hemagglutinin__InfluenzaA__ALA08552

SEQ ID NO: 13038 - protein, 566 aa, Artificial Sequence; identical to SEQ ID NO: 12998
  hemagglutinin__InfluenzaA__ALA08553

SEQ ID NO: 13039 - protein, 566 aa, Artificial Sequence
  hemagglutinin__InfluenzaA__ALA08554
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELMSGYKDWILWISFAISCFLLCVALLGFIMWACQKGNIRCNICI

SEQ ID NO: 13040 - protein, 566 aa, Artificial Sequence
  hemagglutinin__InfluenzaA__ALA08555
MKTIIALSYILCLVFAQKLPENDNSTATLCLGHHAVPNGTIVKTITSDQIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPSIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13041 - protein, 566 aa, Artificial Sequence
  hemagglutinin__InfluenzaA__ALA08556
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGITQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13042 - protein, 566 aa, Artificial Sequence; identical to SEQ ID NO: 12998
  hemagglutinin__InfluenzaA__ALA08557

SEQ ID NO: 13043 - protein, 566 aa, Artificial Sequence; identical to SEQ ID NO: 12998
  hemagglutinin__InfluenzaA__ALA08558

SEQ ID NO: 13044 - protein, 566 aa, Artificial Sequence
  hemagglutinin__InfluenzaA__ALA08559
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYARSSGRITVSTKGSQQAVIPNIGSRPRIRDIPSRISIYWTIVKPGDILLINSAGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13045 - protein, 566 aa, Artificial Sequence; identical to SEQ ID NO: 12441
  hemagglutinin__InfluenzaA__ALA08560

SEQ ID NO: 13046 - protein, 566 aa, Artificial Sequence
  hemagglutinin__InfluenzaA__ALA08561
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNKEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13047 - protein, 566 aa, Artificial Sequence
  hemagglutinin__InfluenzaA__ALA08563
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKILSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13048 - protein, 566 aa, Artificial Sequence
  hemagglutinin__InfluenzaA__ALA08571
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFATSCFLLCVALLGFIMWACQKGNIRCNICI

SEQ ID NO: 13049 - protein, 566 aa, Artificial Sequence; identical to SEQ ID NO: 12984
  hemagglutinin__InfluenzaA__ALA08572

SEQ ID NO: 13050 - protein, 566 aa, Artificial Sequence; identical to SEQ ID NO: 12981
  hemagglutinin__InfluenzaA__ALA08573

SEQ ID NO: 13051 - protein, 566 aa, Artificial Sequence
  hemagglutinin__InfluenzaA__ALA08574
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQISGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13052 - protein, 566 aa, Artificial Sequence
  hemagglutinin__InfluenzaA__ALA08575
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13053 - protein, 566 aa, Artificial Sequence; identical to SEQ ID NO: 12441
  hemagglutinin__InfluenzaA__ALA08576

SEQ ID NO: 13054 - protein, 566 aa, Artificial Sequence; identical to SEQ ID NO: 12441
  hemagglutinin__InfluenzaA__ALA08577

SEQ ID NO: 13055 - protein, 566 aa, Artificial Sequence
  hemagglutinin__InfluenzaA__ALA08579
MKTIIALSYILCLIFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13056 - protein, 566 aa, Artificial Sequence
  hemagglutinin__InfluenzaA__ALA08580
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYARSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13057 - protein, 566 aa, Artificial Sequence
  hemagglutinin__InfluenzaA__ALA08582
MKTIIALSYILCLVFAQKLPENDNSTATLCLGHHAVPNGTIVKTITNDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13058 - protein, 566 aa, Artificial Sequence; identical to SEQ ID NO: 13057
  hemagglutinin__InfluenzaA__ALA08583

SEQ ID NO: 13059 - protein, 566 aa, Artificial Sequence; identical to SEQ ID NO: 13057
  hemagglutinin__InfluenzaA__ALA08584

SEQ ID NO: 13060 - protein, 566 aa, Artificial Sequence; identical to SEQ ID NO: 13057
  hemagglutinin__InfluenzaA__ALA08585

SEQ ID NO: 13061 - protein, 566 aa, Artificial Sequence; identical to SEQ ID NO: 12441
  hemagglutinin__InfluenzaA__ALA08586

SEQ ID NO: 13062 - protein, 566 aa, Artificial Sequence; identical to SEQ ID NO: 13057
  hemagglutinin__InfluenzaA__ALA08587

SEQ ID NO: 13063 - protein, 566 aa, Artificial Sequence; identical to SEQ ID NO: 12441
  hemagglutinin__InfluenzaA__ALA08588

SEQ ID NO: 13064 - protein, 566 aa, Artificial Sequence; identical to SEQ ID NO: 12441
  hemagglutinin__InfluenzaA__ALA08589

SEQ ID NO: 13065 - protein, 566 aa, Artificial Sequence; identical to SEQ ID NO: 13057
  hemagglutinin__InfluenzaA__ALA08590

SEQ ID NO: 13066 - protein, 566 aa, Artificial Sequence; identical to SEQ ID NO: 12441
  hemagglutinin__InfluenzaA__ALA08591

SEQ ID NO: 13067 - protein, 566 aa, Artificial Sequence; identical to SEQ ID NO: 12998
  hemagglutinin__InfluenzaA__ALA08592

SEQ ID NO: 13068 - protein, 566 aa, Artificial Sequence
  hemagglutinin__InfluenzaA__ALA08594
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAMSCFLLCVALLGFIMWACQKGNIRCNICI

SEQ ID NO: 13069 - protein, 566 aa, Artificial Sequence; identical to SEQ ID NO: 12441
  hemagglutinin__InfluenzaA__ALA08595

SEQ ID NO: 13070 - protein, 566 aa, Artificial Sequence; identical to SEQ ID NO: 12441
  hemagglutinin__InfluenzaA__ALA08596

SEQ ID NO: 13071 - protein, 566 aa, Artificial Sequence
  hemagglutinin__InfluenzaA__ALA08597
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQNGNIRCNICI

SEQ ID NO: 13072 - protein, 566 aa, Artificial Sequence
  hemagglutinin__InfluenzaA__ALA08598
MKTIIASSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13073 - protein, 566 aa, Artificial Sequence; identical to SEQ ID NO: 12441
  hemagglutinin__InfluenzaA__ALA08599

SEQ ID NO: 13074 - protein, 566 aa, Artificial Sequence
  hemagglutinin__InfluenzaA__ALA08600
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYRYPALNVTMPNNEQFDKLYIWGVHHPGTDKDQISLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13075 - protein, 566 aa, Artificial Sequence; identical to SEQ ID NO: 12441
  hemagglutinin__InfluenzaA__ALA08601

SEQ ID NO: 13076 - protein, 566 aa, Artificial Sequence
  hemagglutinin__InfluenzaA__ALA08602
MKTIIALSYILCLVFAQKIPGNDNSTATLCLGHHAVPNGTIVKTITNDRIEVTNATELVQNSSIGEICDSPHQILDGENCTLIDALLGDPQCDDFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQISLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13077 - protein, 566 aa, Artificial Sequence
  hemagglutinin__InfluenzaA__ALA08603
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYIYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13078 - protein, 566 aa, Artificial Sequence; identical to SEQ ID NO: 12441
  hemagglutinin__InfluenzaA__ALA08605

SEQ ID NO: 13079 - protein, 566 aa, Artificial Sequence; identical to SEQ ID NO: 12441
  hemagglutinin__InfluenzaA__ALA08606

SEQ ID NO: 13080 - protein, 566 aa, Artificial Sequence; identical to SEQ ID NO: 13056
  hemagglutinin__InfluenzaA__ALA08607

SEQ ID NO: 13081 - protein, 566 aa, Artificial Sequence
  hemagglutinin__InfluenzaA__ALA08609
MKTIIALGYILCLVFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLDKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13082 - protein, 566 aa, Artificial Sequence; identical to SEQ ID NO: 12998
  hemagglutinin__InfluenzaA__ALA08610

SEQ ID NO: 13083 - protein, 566 aa, Artificial Sequence
  hemagglutinin__InfluenzaA__ALA08611
MKIIIALSYILCLVFAQKIPGNDNSTATLCLGHHAVPNGTIVKTITNDRIEVTNATELVQNSSIGEICDSPHRILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13084 - protein, 566 aa, Artificial Sequence; identical to SEQ ID NO: 13056
  hemagglutinin__InfluenzaA__ALA08612

SEQ ID NO: 13085 - protein, 566 aa, Artificial Sequence; identical to SEQ ID NO: 12441
  hemagglutinin__InfluenzaA__ALA08614

SEQ ID NO: 13086 - protein, 566 aa, Artificial Sequence; identical to SEQ ID NO: 12441
  hemagglutinin__InfluenzaA__ALA08615

SEQ ID NO: 13087 - protein, 566 aa, Artificial Sequence; identical to SEQ ID NO: 12441
  hemagglutinin__InfluenzaA__ALA08616

SEQ ID NO: 13088 - protein, 566 aa, Artificial Sequence; identical to SEQ ID NO: 12981
  hemagglutinin__InfluenzaA__ALA08617

SEQ ID NO: 13089 - protein, 566 aa, Artificial Sequence
  hemagglutinin__InfluenzaA__ALA08619
MKTVIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLIASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNEKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGIYDHNVYRDEALNNRFQIKGVELKSGYKDWILWISFAISCFLLCVALLGFIMWACQKGNIRCNICI

SEQ ID NO: 13090 - protein, 566 aa, Artificial Sequence; identical to SEQ ID NO: 13056
  hemagglutinin__InfluenzaA__ALA08620

SEQ ID NO: 13091 - protein, 566 aa, Artificial Sequence; identical to SEQ ID NO: 13047
  hemagglutinin__InfluenzaA__ALA08621

SEQ ID NO: 13092 - protein, 566 aa, Artificial Sequence
  hemagglutinin__InfluenzaA__ALA08622
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13093 - protein, 566 aa, Artificial Sequence; identical to SEQ ID NO: 12441
  hemagglutinin__InfluenzaA__ALA08623

SEQ ID NO: 13094 - protein, 566 aa, Artificial Sequence; identical to SEQ ID NO: 13047
  hemagglutinin__InfluenzaA__ALA08624

SEQ ID NO: 13095 - protein, 566 aa, Artificial Sequence; identical to SEQ ID NO: 12441
  hemagglutinin__InfluenzaA__ALA08625

SEQ ID NO: 13096 - protein, 566 aa, Artificial Sequence; identical to SEQ ID NO: 12441
  hemagglutinin__InfluenzaA__ALA08626

SEQ ID NO: 13097 - protein, 566 aa, Artificial Sequence; identical to SEQ ID NO: 12441
  hemagglutinin__InfluenzaA__ALA08627

SEQ ID NO: 13098 - protein, 566 aa, Artificial Sequence; identical to SEQ ID NO: 12985
  hemagglutinin__InfluenzaA__ALA08629

SEQ ID NO: 13099 - protein, 566 aa, Artificial Sequence
  hemagglutinin__InfluenzaA__ALA08630
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13100 - protein, 566 aa, Artificial Sequence
  hemagglutinin__InfluenzaA__ALA08631
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNKEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13101 - protein, 566 aa, Artificial Sequence
  hemagglutinin__InfluenzaA__ALA08632
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKGSQQAVIPNVGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13102 - protein, 566 aa, Artificial Sequence; identical to SEQ ID NO: 12998
  hemagglutinin__InfluenzaA__ALA08634

SEQ ID NO: 13103 - protein, 566 aa, Artificial Sequence; identical to SEQ ID NO: 12441
  hemagglutinin__InfluenzaA__ALA08635

SEQ ID NO: 13104 - protein, 566 aa, Artificial Sequence
  hemagglutinin__InfluenzaA__ALA08636
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGIHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13105 - protein, 566 aa, Artificial Sequence; identical to SEQ ID NO: 12998
  hemagglutinin__InfluenzaA__ALA08637

SEQ ID NO: 13106 - protein, 566 aa, Artificial Sequence
  hemagglutinin__InfluenzaA__ALA08638
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13107 - protein, 566 aa, Artificial Sequence; identical to SEQ ID NO: 12998
  hemagglutinin__InfluenzaA__ALA08639

SEQ ID NO: 13108 - protein, 566 aa, Artificial Sequence; identical to SEQ ID NO: 12998
  hemagglutinin__InfluenzaA__ALA08640

SEQ ID NO: 13109 - protein, 566 aa, Artificial Sequence; identical to SEQ ID NO: 12998
  hemagglutinin__InfluenzaA__ALA08641

SEQ ID NO: 13110 - protein, 566 aa, Artificial Sequence; identical to SEQ ID NO: 12998
  hemagglutinin__InfluenzaA__ALA08642

SEQ ID NO: 13111 - protein, 566 aa, Artificial Sequence; identical to SEQ ID NO: 12998
  hemagglutinin__InfluenzaA__ALA08643

SEQ ID NO: 13112 - protein, 566 aa, Artificial Sequence; identical to SEQ ID NO: 12441
  hemagglutinin__InfluenzaA__ALA08644

SEQ ID NO: 13113 - protein, 566 aa, Artificial Sequence
  hemagglutinin__InfluenzaA__ALA08645
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDIWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13114 - protein, 566 aa, Artificial Sequence; identical to SEQ ID NO: 12441
  hemagglutinin__InfluenzaA__ALA08646

SEQ ID NO: 13115 - protein, 566 aa, Artificial Sequence; identical to SEQ ID NO: 12441
  hemagglutinin__InfluenzaA__ALA08647

SEQ ID NO: 13116 - protein, 566 aa, Artificial Sequence; identical to SEQ ID NO: 12998
  hemagglutinin__InfluenzaA__ALA08648

SEQ ID NO: 13117 - protein, 566 aa, Artificial Sequence
  hemagglutinin__InfluenzaA__ALA08650
MKTIIALSYILCLVFAQKIPGNDNSTATLCLGHHAVPNGTIVKTITNERIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13118 - protein, 566 aa, Artificial Sequence; identical to SEQ ID NO: 12998
  hemagglutinin__InfluenzaA__ALA08652

SEQ ID NO: 13119 - protein, 566 aa, Artificial Sequence; identical to SEQ ID NO: 12441
  hemagglutinin__InfluenzaA__ALA08653

SEQ ID NO: 13120 - protein, 566 aa, Artificial Sequence
  hemagglutinin__InfluenzaA__ALA08654
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAKSCFLLCVALLGFIMWACQKGNIRCNICI

SEQ ID NO: 13121 - protein, 566 aa, Artificial Sequence; identical to SEQ ID NO: 12998
  hemagglutinin__InfluenzaA__ALA08655

SEQ ID NO: 13122 - protein, 566 aa, Artificial Sequence; identical to SEQ ID NO: 12998
  hemagglutinin__InfluenzaA__ALA08656

SEQ ID NO: 13123 - protein, 566 aa, Artificial Sequence
  hemagglutinin__InfluenzaA__ALA08657
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFIERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13124 - protein, 566 aa, Artificial Sequence; identical to SEQ ID NO: 12998
  hemagglutinin__InfluenzaA__ALA08658

SEQ ID NO: 13125 - protein, 566 aa, Artificial Sequence; identical to SEQ ID NO: 12985
  hemagglutinin__InfluenzaA__ALA08659

SEQ ID NO: 13126 - protein, 566 aa, Artificial Sequence
  hemagglutinin__InfluenzaA__ALA08660
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHGTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13127 - protein, 566 aa, Artificial Sequence
  hemagglutinin__InfluenzaA__ALA08662
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKILSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDSKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13128 - protein, 566 aa, Artificial Sequence; identical to SEQ ID NO: 13099
  hemagglutinin__InfluenzaA__ALA08663

SEQ ID NO: 13129 - protein, 566 aa, Artificial Sequence; identical to SEQ ID NO: 13127
  hemagglutinin__InfluenzaA__ALA08665

SEQ ID NO: 13130 - protein, 566 aa, Artificial Sequence
  hemagglutinin__InfluenzaA__ALA08666
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAMSCFLLCVALLGFIMWACQKGNIRCNICI

SEQ ID NO: 13131 - protein, 566 aa, Artificial Sequence
  hemagglutinin__InfluenzaA__ALA08667
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYKYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13132 - protein, 566 aa, Artificial Sequence
  hemagglutinin__InfluenzaA__ALA08668
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEAINNRFQIKGVELKSGYKDWILWISFAISCFLLCVALLGFIMWACQKGNIRCNICI

SEQ ID NO: 13133 - protein, 566 aa, Artificial Sequence; identical to SEQ ID NO: 13099
  hemagglutinin__InfluenzaA__ALA08669

SEQ ID NO: 13134 - protein, 566 aa, Artificial Sequence; identical to SEQ ID NO: 12992
  hemagglutinin__InfluenzaA__ALA08670

SEQ ID NO: 13135 - protein, 566 aa, Artificial Sequence; identical to SEQ ID NO: 13099
  hemagglutinin__InfluenzaA__ALA08671

SEQ ID NO: 13136 - protein, 566 aa, Artificial Sequence; identical to SEQ ID NO: 13099
  hemagglutinin__InfluenzaA__ALA08672

SEQ ID NO: 13137 - protein, 566 aa, Artificial Sequence; identical to SEQ ID NO: 12992
  hemagglutinin__InfluenzaA__ALA08673

SEQ ID NO: 13138 - protein, 566 aa, Artificial Sequence; identical to SEQ ID NO: 13099
  hemagglutinin__InfluenzaA__ALA08674

SEQ ID NO: 13139 - protein, 566 aa, Artificial Sequence; identical to SEQ ID NO: 12441
  hemagglutinin__InfluenzaA__ALA08675

SEQ ID NO: 13140 - protein, 566 aa, Artificial Sequence; identical to SEQ ID NO: 13099
  hemagglutinin__InfluenzaA__ALA08676

SEQ ID NO: 13141 - protein, 566 aa, Artificial Sequence; identical to SEQ ID NO: 13099
  hemagglutinin__InfluenzaA__ALA08677

SEQ ID NO: 13142 - protein, 566 aa, Artificial Sequence; identical to SEQ ID NO: 13099
  hemagglutinin__InfluenzaA__ALA08678

SEQ ID NO: 13143 - protein, 566 aa, Artificial Sequence; identical to SEQ ID NO: 13099
  hemagglutinin__InfluenzaA__ALA08679

SEQ ID NO: 13144 - protein, 566 aa, Artificial Sequence; identical to SEQ ID NO: 13099
  hemagglutinin__InfluenzaA__ALA08680

SEQ ID NO: 13145 - protein, 566 aa, Artificial Sequence; identical to SEQ ID NO: 12998
  hemagglutinin__InfluenzaA__ALA08681

SEQ ID NO: 13146 - protein, 566 aa, Artificial Sequence; identical to SEQ ID NO: 13077
  hemagglutinin__InfluenzaA__ALA08682

SEQ ID NO: 13147 - protein, 566 aa, Artificial Sequence; identical to SEQ ID NO: 12998
  hemagglutinin__InfluenzaA__ALA08683

SEQ ID NO: 13148 - protein, 566 aa, Artificial Sequence
  hemagglutinin__InfluenzaA__ALA08684
MKTIIALSHILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFLYAQSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGIELKSGYKDWILWISFAISCFLLCVALLGFIMWACQKGNIRCNICI

SEQ ID NO: 13149 - protein, 566 aa, Artificial Sequence; identical to SEQ ID NO: 12441
  hemagglutinin__InfluenzaA__ALA08686

SEQ ID NO: 13150 - protein, 566 aa, Artificial Sequence
  hemagglutinin__InfluenzaA__ALA08687
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLIASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13151 - protein, 566 aa, Artificial Sequence; identical to SEQ ID NO: 13092
  hemagglutinin__InfluenzaA__ALA08688

SEQ ID NO: 13152 - protein, 566 aa, Artificial Sequence; identical to SEQ ID NO: 12441
  hemagglutinin__InfluenzaA__ALE31612

SEQ ID NO: 13153 - protein, 566 aa, Artificial Sequence
  hemagglutinin__InfluenzaA__ALE31613
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKGSQQAVIPNIGSRPRIRDIPSRISIYWTIVKPGDILLISSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCLLLCVALLGFIMWACQKGNIRCNICI

SEQ ID NO: 13154 - protein, 566 aa, Artificial Sequence
  hemagglutinin__InfluenzaA__ALE31614
MKTIIALSYILCLVFAQKIPGNDNSTATLCLGHHAVPNGTIVKTITNDRIEVTNATELVQNSSIGKICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13155 - protein, 566 aa, Artificial Sequence
  hemagglutinin__InfluenzaA__ALE31615
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 13156 - protein, 566 aa, Artificial Sequence; identical to SEQ ID NO: 12441
  hemagglutinin__InfluenzaA__ALE31616

SEQ ID NO: 13157 - protein, 566 aa, Artificial Sequence; identical to SEQ ID NO: 12441
  hemagglutinin__InfluenzaA__ALE31617

SEQ ID NO: 13158 - protein, 566 aa, Artificial Sequence; identical to SEQ ID NO: 12441
  hemagglutinin__InfluenzaA__ALE31618

SEQ ID NO: 13159 - protein, 566 aa, Artificial Sequence; identical to SEQ ID NO: 13099
  hemagglutinin__InfluenzaA__ALE31619

SEQ ID NO: 13160 - protein, 566 aa, Artificial Sequence; identical to SEQ ID NO: 12441
  hemagglutinin__InfluenzaA__ALE31620

SEQ ID NO: 13161 - protein, 566 aa, Artificial Sequence
  hemagglutinin__InfluenzaA__ALE31622
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDVPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13162 - protein, 566 aa, Artificial Sequence; identical to SEQ ID NO: 12441
  hemagglutinin__InfluenzaA__ALE31623

SEQ ID NO: 13163 - protein, 566 aa, Artificial Sequence; identical to SEQ ID NO: 12441
  hemagglutinin__InfluenzaA__ALE31625

SEQ ID NO: 13164 - protein, 566 aa, Artificial Sequence; identical to SEQ ID NO: 12441
  hemagglutinin__InfluenzaA__ALE31626

SEQ ID NO: 13165 - protein, 566 aa, Artificial Sequence; identical to SEQ ID NO: 12441
  hemagglutinin__InfluenzaA__ALE31627

SEQ ID NO: 13166 - protein, 566 aa, Artificial Sequence; identical to SEQ ID NO: 12441
  hemagglutinin__InfluenzaA__ALE31628

SEQ ID NO: 13167 - protein, 566 aa, Artificial Sequence; identical to SEQ ID NO: 12441
  hemagglutinin__InfluenzaA__ALE31629

SEQ ID NO: 13168 - protein, 566 aa, Artificial Sequence; identical to SEQ ID NO: 12441
  hemagglutinin__InfluenzaA__ALE31632

SEQ ID NO: 13169 - protein, 566 aa, Artificial Sequence
  hemagglutinin__InfluenzaA__ALE31634
MKTIIALSYILCLVLAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13170 - protein, 566 aa, Artificial Sequence; identical to SEQ ID NO: 12441
  hemagglutinin__InfluenzaA__ALE31635

SEQ ID NO: 13171 - protein, 566 aa, Artificial Sequence; identical to SEQ ID NO: 12441
  hemagglutinin__InfluenzaA__ALE31636

SEQ ID NO: 13172 - protein, 566 aa, Artificial Sequence
  hemagglutinin__InfluenzaA__ALE31638
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNGKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13173 - protein, 566 aa, Artificial Sequence; identical to SEQ ID NO: 12441
  hemagglutinin__InfluenzaA__ALE31639

SEQ ID NO: 13174 - protein, 566 aa, Artificial Sequence; identical to SEQ ID NO: 12992
  hemagglutinin__InfluenzaA__ALE31640

SEQ ID NO: 13175 - protein, 566 aa, Artificial Sequence; identical to SEQ ID NO: 12998
  hemagglutinin__InfluenzaA__ALE31641

SEQ ID NO: 13176 - protein, 566 aa, Artificial Sequence; identical to SEQ ID NO: 12998
  hemagglutinin__InfluenzaA__ALE31642

SEQ ID NO: 13177 - protein, 566 aa, Artificial Sequence
  hemagglutinin__InfluenzaA__ALE31643
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSTAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13178 - protein, 566 aa, Artificial Sequence; identical to SEQ ID NO: 12441
  hemagglutinin__InfluenzaA__ALE31644

SEQ ID NO: 13179 - protein, 566 aa, Artificial Sequence; identical to SEQ ID NO: 12441
  hemagglutinin__InfluenzaA__ALE31645

SEQ ID NO: 13180 - protein, 566 aa, Artificial Sequence; identical to SEQ ID NO: 12441
  hemagglutinin__InfluenzaA__ALE31646

SEQ ID NO: 13181 - protein, 566 aa, Artificial Sequence; identical to SEQ ID NO: 12998
  hemagglutinin__InfluenzaA__ALE31647

SEQ ID NO: 13182 - protein, 566 aa, Artificial Sequence
  hemagglutinin__InfluenzaA__ALE31648
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQPSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAATDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13183 - protein, 566 aa, Artificial Sequence; identical to SEQ ID NO: 12441
  hemagglutinin__InfluenzaA__ALE31649

SEQ ID NO: 13184 - protein, 566 aa, Artificial Sequence; identical to SEQ ID NO: 12998
  hemagglutinin__InfluenzaA__ALE31650

SEQ ID NO: 13185 - protein, 566 aa, Artificial Sequence
  hemagglutinin__InfluenzaA__ALE31652
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQISLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13186 - protein, 566 aa, Artificial Sequence; identical to SEQ ID NO: 13092
  hemagglutinin__InfluenzaA__ALE31653

SEQ ID NO: 13187 - protein, 566 aa, Artificial Sequence; identical to SEQ ID NO: 12441
  hemagglutinin__InfluenzaA__ALE31654

SEQ ID NO: 13188 - protein, 566 aa, Artificial Sequence; identical to SEQ ID NO: 12441
  hemagglutinin__InfluenzaA__ALE31655

SEQ ID NO: 13189 - protein, 566 aa, Artificial Sequence
  hemagglutinin__InfluenzaA__ALE31656
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDIFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13190 - protein, 566 aa, Artificial Sequence
  hemagglutinin__InfluenzaA__ALE31657
MKTIIALSYILCLVSAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13191 - protein, 566 aa, Artificial Sequence; identical to SEQ ID NO: 12441
  hemagglutinin__InfluenzaA__ALE31658

SEQ ID NO: 13192 - protein, 566 aa, Artificial Sequence; identical to SEQ ID NO: 13056
  hemagglutinin__InfluenzaA__ALE31659

SEQ ID NO: 13193 - protein, 566 aa, Artificial Sequence; identical to SEQ ID NO: 12985
  hemagglutinin__InfluenzaA__ALE31660

SEQ ID NO: 13194 - protein, 566 aa, Artificial Sequence
  hemagglutinin__InfluenzaA__ALE31661
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKKSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13195 - protein, 566 aa, Artificial Sequence
  hemagglutinin__InfluenzaA__ALE31662
MKTIIALSYILCLVFAQKIPGNDNSTATLCLGHHAVPNGTIVKTIANDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCLLLCVALLGFIMWACQKGNIRCNICI

SEQ ID NO: 13196 - protein, 566 aa, Artificial Sequence; identical to SEQ ID NO: 12427
  hemagglutinin__InfluenzaA__ALE31663

SEQ ID NO: 13197 - protein, 566 aa, Artificial Sequence
  hemagglutinin__InfluenzaA__ALE31666
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLKYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13198 - protein, 566 aa, Artificial Sequence
  hemagglutinin__InfluenzaA__ALE31667
MKTIIALSYILCLVFAQKIPGNDNSTATLCLGHHAVLNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13199 - protein, 566 aa, Artificial Sequence; identical to SEQ ID NO: 12441
  hemagglutinin__InfluenzaA__ALE31668

SEQ ID NO: 13200 - protein, 566 aa, Artificial Sequence; identical to SEQ ID NO: 12441
  hemagglutinin__InfluenzaA__ALE31669

SEQ ID NO: 13201 - protein, 566 aa, Artificial Sequence
  hemagglutinin__InfluenzaA__ALE31670
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQMRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13202 - protein, 566 aa, Artificial Sequence; identical to SEQ ID NO: 12441
  hemagglutinin__InfluenzaA__ALE31671

SEQ ID NO: 13203 - protein, 566 aa, Artificial Sequence; identical to SEQ ID NO: 12441
  hemagglutinin__InfluenzaA__ALE31672

SEQ ID NO: 13204 - protein, 566 aa, Artificial Sequence; identical to SEQ ID NO: 12998
  hemagglutinin__InfluenzaA__ALE31673

SEQ ID NO: 13205 - protein, 566 aa, Artificial Sequence
  hemagglutinin__InfluenzaA__ALE31674
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAHSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13206 - protein, 566 aa, Artificial Sequence
  hemagglutinin__InfluenzaA__ALE31675
MKTIIALSYILCLVFAQKIPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13207 - protein, 566 aa, Artificial Sequence
  hemagglutinin__InfluenzaA__ALE31676
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPKIRDIPSRISIYWTIVKPGDILLINSTGNLIAPRGYFKILSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDSKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13208 - protein, 566 aa, Artificial Sequence; identical to SEQ ID NO: 13099
  hemagglutinin__InfluenzaA__ALE31677

SEQ ID NO: 13209 - protein, 566 aa, Artificial Sequence; identical to SEQ ID NO: 12441
  hemagglutinin__InfluenzaA__ALE31678

SEQ ID NO: 13210 - protein, 566 aa, Artificial Sequence; identical to SEQ ID NO: 12441
  hemagglutinin__InfluenzaA__ALE31679

SEQ ID NO: 13211 - protein, 566 aa, Artificial Sequence; identical to SEQ ID NO: 13057
  hemagglutinin__InfluenzaA__ALE31680

SEQ ID NO: 13212 - protein, 566 aa, Artificial Sequence; identical to SEQ ID NO: 13056
  hemagglutinin__InfluenzaA__ALE31681

SEQ ID NO: 13213 - protein, 566 aa, Artificial Sequence; identical to SEQ ID NO: 12441
  hemagglutinin__InfluenzaA__ALE31682

SEQ ID NO: 13214 - protein, 566 aa, Artificial Sequence; identical to SEQ ID NO: 12441
  hemagglutinin__InfluenzaA__ALE31683

SEQ ID NO: 13215 - protein, 566 aa, Artificial Sequence; identical to SEQ ID NO: 12441
  hemagglutinin__InfluenzaA__ALE31684

SEQ ID NO: 13216 - protein, 566 aa, Artificial Sequence; identical to SEQ ID NO: 12441
  hemagglutinin__InfluenzaA__ALE31685

SEQ ID NO: 13217 - protein, 566 aa, Artificial Sequence; identical to SEQ ID NO: 12441
  hemagglutinin__InfluenzaA__ALE31686

SEQ ID NO: 13218 - protein, 566 aa, Artificial Sequence
  hemagglutinin__InfluenzaA__ALE31687
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIESIRNGTYDHNVYRDEALNNRFQIKGVELKSGYKDWILWISFAISCFLLCVALLGFIMWACQKGNIRCNICI

SEQ ID NO: 13219 - protein, 566 aa, Artificial Sequence
  hemagglutinin__InfluenzaA__ALE31688
MKTTIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13220 - protein, 566 aa, Artificial Sequence; identical to SEQ ID NO: 12441
  hemagglutinin__InfluenzaA__ALE31689

SEQ ID NO: 13221 - protein, 566 aa, Artificial Sequence
  hemagglutinin__InfluenzaA__ALE31690
MKTIIALSCILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13222 - protein, 566 aa, Artificial Sequence; identical to SEQ ID NO: 9994
  hemagglutinin__InfluenzaA__ALE31691

SEQ ID NO: 13223 - protein, 566 aa, Artificial Sequence
  hemagglutinin__InfluenzaA__ALE31692
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGYRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13224 - protein, 566 aa, Artificial Sequence; identical to SEQ ID NO: 13223
  hemagglutinin__InfluenzaA__ALE31693

SEQ ID NO: 13225 - protein, 566 aa, Artificial Sequence; identical to SEQ ID NO: 12441
  hemagglutinin__InfluenzaA__ALE31694

SEQ ID NO: 13226 - protein, 566 aa, Artificial Sequence; identical to SEQ ID NO: 13223
  hemagglutinin__InfluenzaA__ALE31695

SEQ ID NO: 13227 - protein, 566 aa, Artificial Sequence; identical to SEQ ID NO: 13099
  hemagglutinin__InfluenzaA__ALE31696

SEQ ID NO: 13228 - protein, 566 aa, Artificial Sequence; identical to SEQ ID NO: 13223
  hemagglutinin__InfluenzaA__ALE31697

SEQ ID NO: 13229 - protein, 566 aa, Artificial Sequence
  hemagglutinin__InfluenzaA__ALE31698
MKTIIALSYILCMVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13230 - protein, 566 aa, Artificial Sequence
  hemagglutinin__InfluenzaA__ALE31699
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPNYASLRSLVASSGTLEFNNESFNWTGVTQNGTSSACIRRSSSSFFSRLNWLTHLNYAYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13231 - protein, 566 aa, Artificial Sequence; identical to SEQ ID NO: 12441
  hemagglutinin__InfluenzaA__ALE31700

SEQ ID NO: 13232 - protein, 566 aa, Artificial Sequence; identical to SEQ ID NO: 12441
  hemagglutinin__InfluenzaA__ALE31701

SEQ ID NO: 13233 - protein, 566 aa, Artificial Sequence; identical to SEQ ID NO: 12998
  hemagglutinin__InfluenzaA__ALE31702

SEQ ID NO: 13234 - protein, 566 aa, Artificial Sequence; identical to SEQ ID NO: 12441
  hemagglutinin__InfluenzaA__ALE31703

SEQ ID NO: 13235 - protein, 566 aa, Artificial Sequence; identical to SEQ ID NO: 12441
  hemagglutinin__InfluenzaA__ALE31704

SEQ ID NO: 13236 - protein, 566 aa, Artificial Sequence; identical to SEQ ID NO: 12998
  hemagglutinin__InfluenzaA__ALE31705

SEQ ID NO: 13237 - protein, 566 aa, Artificial Sequence
  hemagglutinin__InfluenzaA__ALE31706
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCLLLCVALLGFIMWACQKGNIRCNICI

SEQ ID NO: 13238 - protein, 566 aa, Artificial Sequence; identical to SEQ ID NO: 13127
  hemagglutinin__InfluenzaA__ALE31707

SEQ ID NO: 13239 - protein, 566 aa, Artificial Sequence; identical to SEQ ID NO: 13127
  hemagglutinin__InfluenzaA__ALE31708

SEQ ID NO: 13240 - protein, 566 aa, Artificial Sequence; identical to SEQ ID NO: 12427
  hemagglutinin__InfluenzaA__ALE31709

SEQ ID NO: 13241 - protein, 566 aa, Artificial Sequence
  hemagglutinin__InfluenzaA__ALE31710
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRLRIRDIPSRISIYWTIVKPGDILLINSTGNLIAPRGYFKILSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDSKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13242 - protein, 566 aa, Artificial Sequence; identical to SEQ ID NO: 13127
  hemagglutinin__InfluenzaA__ALE31711

SEQ ID NO: 13243 - protein, 566 aa, Artificial Sequence; identical to SEQ ID NO: 12985
  hemagglutinin__InfluenzaA__ALE31712

SEQ ID NO: 13244 - protein, 566 aa, Artificial Sequence
  hemagglutinin__InfluenzaA__ALE31713
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGIHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNIPEKQTKGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFATSCFLLCVALLGFIMWACQKGNIRCNICI

SEQ ID NO: 13245 - protein, 566 aa, Artificial Sequence; identical to SEQ ID NO: 13099
  hemagglutinin__InfluenzaA__ALE31714

SEQ ID NO: 13246 - protein, 566 aa, Artificial Sequence; identical to SEQ ID NO: 13099
  hemagglutinin__InfluenzaA__ALE31715

SEQ ID NO: 13247 - protein, 566 aa, Artificial Sequence; identical to SEQ ID NO: 13127
  hemagglutinin__InfluenzaA__ALE31716

SEQ ID NO: 13248 - protein, 566 aa, Artificial Sequence
  hemagglutinin__InfluenzaA__ALE31717
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYKYPALNVTMPNNEQFDKLYIWGVHHPGTDKDQIFLYARSSGRITVSTKTSQQAVIPNIGSRPRIRDIPSRISIYWTIVKPGDILLINSTGNLIAPRGYFKIRSGKSSIMRSDAPIGKCKSECITPNGSIPNDKPFQNVNRTTYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13249 - protein, 566 aa, Artificial Sequence; identical to SEQ ID NO: 13099
  hemagglutinin__InfluenzaA__ALE31718

SEQ ID NO: 13250 - protein, 566 aa, Artificial Sequence
  hemagglutinin__InfluenzaA__ALE31719
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNIPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13251 - protein, 566 aa, Artificial Sequence; identical to SEQ ID NO: 12985
  hemagglutinin__InfluenzaA__ALE31720

SEQ ID NO: 13252 - protein, 566 aa, Artificial Sequence; identical to SEQ ID NO: 12998
  hemagglutinin__InfluenzaA__ALE31721

SEQ ID NO: 13253 - protein, 566 aa, Artificial Sequence; identical to SEQ ID NO: 13221
  hemagglutinin__InfluenzaA__ALE31722

SEQ ID NO: 13254 - protein, 566 aa, Artificial Sequence
  hemagglutinin__InfluenzaA__ALE31723
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECTTPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13255 - protein, 566 aa, Artificial Sequence; identical to SEQ ID NO: 12441
  hemagglutinin__InfluenzaA__ALE31724

SEQ ID NO: 13256 - protein, 566 aa, Artificial Sequence; identical to SEQ ID NO: 12441
  hemagglutinin__InfluenzaA__ALE31725

SEQ ID NO: 13257 - protein, 566 aa, Artificial Sequence; identical to SEQ ID NO: 12441
  hemagglutinin__InfluenzaA__ALE31726

SEQ ID NO: 13258 - protein, 566 aa, Artificial Sequence; identical to SEQ ID NO: 12441
  hemagglutinin__InfluenzaA__ALE31727

SEQ ID NO: 13259 - protein, 566 aa, Artificial Sequence
  hemagglutinin__InfluenzaA__ALE31728
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTIPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13260 - protein, 566 aa, Artificial Sequence
  hemagglutinin__InfluenzaA__ALE31729
MKTIIALSYILCLVFAQKIPGNDNSTATLCLGHHAVPNGTIVKTITNDRIEVTNATELVQNSSIGEICDSPHQIIDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13261 - protein, 566 aa, Artificial Sequence; identical to SEQ ID NO: 12441
  hemagglutinin__InfluenzaA__ALE31730

SEQ ID NO: 13262 - protein, 566 aa, Artificial Sequence
  hemagglutinin__InfluenzaA__ALE31731
MKTIIALSYILCQVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13263 - protein, 566 aa, Artificial Sequence; identical to SEQ ID NO: 13099
  hemagglutinin__InfluenzaA__ALE31732

SEQ ID NO: 13264 - protein, 566 aa, Artificial Sequence; identical to SEQ ID NO: 13099
  hemagglutinin__InfluenzaA__ALE31733

SEQ ID NO: 13265 - protein, 566 aa, Artificial Sequence
  hemagglutinin__InfluenzaA__ALE31734
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLKYTYPALNVTMPNNEQFDKLYIWGVHHPGTDKDQIFLYARSSGRITVSTKRSQQAVIPNIGFRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13266 - protein, 566 aa, Artificial Sequence; identical to SEQ ID NO: 13099
  hemagglutinin__InfluenzaA__ALE31735

SEQ ID NO: 13267 - protein, 566 aa, Artificial Sequence; identical to SEQ ID NO: 12998
  hemagglutinin__InfluenzaA__ALE31736

SEQ ID NO: 13268 - protein, 566 aa, Artificial Sequence; identical to SEQ ID NO: 12998
  hemagglutinin__InfluenzaA__ALE31737

SEQ ID NO: 13269 - protein, 566 aa, Artificial Sequence
  hemagglutinin__InfluenzaA__ALE31738
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFLYAQSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13270 - protein, 566 aa, Artificial Sequence; identical to SEQ ID NO: 12441
  hemagglutinin__InfluenzaA__ALE31739

SEQ ID NO: 13271 - protein, 566 aa, Artificial Sequence
  hemagglutinin__InfluenzaA__ALE31741
MKTIIALSYILCLVFAQKLPENDNSTATLCLGHHAVPNGTIVKTITSDRIEVTNATELVQNSSISEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13272 - protein, 566 aa, Artificial Sequence
  hemagglutinin__InfluenzaA__ALE31742
MKTIIALSYILCLGFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRVTYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13273 - protein, 566 aa, Artificial Sequence; identical to SEQ ID NO: 12998
  hemagglutinin__InfluenzaA__ALE31743

SEQ ID NO: 13274 - protein, 566 aa, Artificial Sequence; identical to SEQ ID NO: 12441
  hemagglutinin__InfluenzaA__ALE31744

SEQ ID NO: 13275 - protein, 566 aa, Artificial Sequence
  hemagglutinin__InfluenzaA__ALE31745
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKRWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRLRIRNIPSRISIYWTIVKPGDILLINSTGNLIAPRGYFKIQSGKSSIMRSDAPIGKCKSECITPNGSIPNDKPFQNVNKITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13276 - protein, 566 aa, Artificial Sequence
  hemagglutinin__InfluenzaA__ALE31747
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKRWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIQSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRVQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13277 - protein, 566 aa, Artificial Sequence; identical to SEQ ID NO: 12998
  hemagglutinin__InfluenzaA__ALE31748

SEQ ID NO: 13278 - protein, 566 aa, Artificial Sequence; identical to SEQ ID NO: 12441
  hemagglutinin__InfluenzaA__ALE31749

SEQ ID NO: 13279 - protein, 566 aa, Artificial Sequence; identical to SEQ ID NO: 12985
  hemagglutinin__InfluenzaA__ALE31750

SEQ ID NO: 13280 - protein, 566 aa, Artificial Sequence
  hemagglutinin__InfluenzaA__ALE31751
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLDYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13281 - protein, 566 aa, Artificial Sequence; identical to SEQ ID NO: 12441
  hemagglutinin__InfluenzaA__ALE31752

SEQ ID NO: 13282 - protein, 566 aa, Artificial Sequence; identical to SEQ ID NO: 12985
  hemagglutinin__InfluenzaA__ALE31753

SEQ ID NO: 13283 - protein, 566 aa, Artificial Sequence; identical to SEQ ID NO: 12441
  hemagglutinin__InfluenzaA__ALE31754

SEQ ID NO: 13284 - protein, 566 aa, Artificial Sequence
  hemagglutinin__InfluenzaA__ALE31755
MKTIIALSYILCLVFAQKLPENDNSTATLCLGHHAVPNGTIVKTITSDQIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13285 - protein, 566 aa, Artificial Sequence; identical to SEQ ID NO: 12985
  hemagglutinin__InfluenzaA__ALE31756

SEQ ID NO: 13286 - protein, 566 aa, Artificial Sequence; identical to SEQ ID NO: 12441
  hemagglutinin__InfluenzaA__ALE31757

SEQ ID NO: 13287 - protein, 566 aa, Artificial Sequence
  hemagglutinin__InfluenzaA__ALE31758
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLVAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13288 - protein, 566 aa, Artificial Sequence
  hemagglutinin__InfluenzaA__ALE31759
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKRWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRVTVSTKRSQQAVIPNIGSRPRIRNIPSRISIYWTIVKPGDILLINSTGNLIAPRGYFKIQSGKSSIMRSDAPIGKCKSECITPNGSIPNNKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13289 - protein, 566 aa, Artificial Sequence
  hemagglutinin__InfluenzaA__ALE31760
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGYRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDAKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13290 - protein, 566 aa, Artificial Sequence; identical to SEQ ID NO: 12985
  hemagglutinin__InfluenzaA__ALE31761

SEQ ID NO: 13291 - protein, 566 aa, Artificial Sequence; identical to SEQ ID NO: 12441
  hemagglutinin__InfluenzaA__ALE31762

SEQ ID NO: 13292 - protein, 566 aa, Artificial Sequence; identical to SEQ ID NO: 13047
  hemagglutinin__InfluenzaA__ALE31763

SEQ ID NO: 13293 - protein, 566 aa, Artificial Sequence; identical to SEQ ID NO: 13099
  hemagglutinin__InfluenzaA__ALE31764

SEQ ID NO: 13294 - protein, 566 aa, Artificial Sequence; identical to SEQ ID NO: 12441
  hemagglutinin__InfluenzaA__ALE31765

SEQ ID NO: 13295 - protein, 566 aa, Artificial Sequence
  hemagglutinin__InfluenzaA__ALE31774
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQVFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13296 - protein, 566 aa, Artificial Sequence
  hemagglutinin__InfluenzaA__ALE31775
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAEFLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13297 - protein, 566 aa, Artificial Sequence
  hemagglutinin__InfluenzaA__ALE31776
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDASIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13298 - protein, 566 aa, Artificial Sequence
  hemagglutinin__InfluenzaA__ALE31777
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVVPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13299 - protein, 566 aa, Artificial Sequence; identical to SEQ ID NO: 13047
  hemagglutinin__InfluenzaA__ALE31778

SEQ ID NO: 13300 - protein, 566 aa, Artificial Sequence; identical to SEQ ID NO: 12441
  hemagglutinin__InfluenzaA__ALE31779

SEQ ID NO: 13301 - protein, 566 aa, Artificial Sequence
  hemagglutinin__InfluenzaA__ALE31780
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAHSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRTDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13302 - protein, 566 aa, Artificial Sequence
  hemagglutinin__InfluenzaA__ALE31781
MKTIIALSYILCLVFAQKIPGNDNSTATLCLGHHAVPNGTIVKTITNDRIEVTNATELVQNSSIGEICGSPHQILDGENCTLIDALLGDPQCDGFQNKKWDLFVERSKAYSNCYPYDVPDYASLRSLVASSGTLEFNNESFNWTGVTQNGTSSACIRKSSSSFFSKLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13303 - protein, 566 aa, Artificial Sequence
  hemagglutinin__InfluenzaA__ALE31782
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYVSLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13304 - protein, 566 aa, Artificial Sequence
  hemagglutinin__InfluenzaA__ALE31783
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTVPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13305 - protein, 566 aa, Artificial Sequence; identical to SEQ ID NO: 13057
  hemagglutinin__InfluenzaA__ALE31784

SEQ ID NO: 13306 - protein, 566 aa, Artificial Sequence; identical to SEQ ID NO: 12441
  hemagglutinin__InfluenzaA__ALE31785

SEQ ID NO: 13307 - protein, 566 aa, Artificial Sequence; identical to SEQ ID NO: 13047
  hemagglutinin__InfluenzaA__ALE31786

SEQ ID NO: 13308 - protein, 566 aa, Artificial Sequence; identical to SEQ ID NO: 13099
  hemagglutinin__InfluenzaA__ALE31787

SEQ ID NO: 13309 - protein, 566 aa, Artificial Sequence; identical to SEQ ID NO: 12541
  hemagglutinin__InfluenzaA__ALE31788

SEQ ID NO: 13310 - protein, 566 aa, Artificial Sequence; identical to SEQ ID NO: 12441
  hemagglutinin__InfluenzaA__ALE31789

SEQ ID NO: 13311 - protein, 566 aa, Artificial Sequence; identical to SEQ ID NO: 13056
  hemagglutinin__InfluenzaA__ALE31790

SEQ ID NO: 13312 - protein, 566 aa, Artificial Sequence; identical to SEQ ID NO: 13177
  hemagglutinin__InfluenzaA__ALE31791

SEQ ID NO: 13313 - protein, 566 aa, Artificial Sequence; identical to SEQ ID NO: 13077
  hemagglutinin__InfluenzaA__ALE31792

SEQ ID NO: 13314 - protein, 566 aa, Artificial Sequence
  hemagglutinin__InfluenzaA__ALE31793
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQISLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13315 - protein, 566 aa, Artificial Sequence; identical to SEQ ID NO: 12441
  hemagglutinin__InfluenzaA__ALE31794

SEQ ID NO: 13316 - protein, 566 aa, Artificial Sequence; identical to SEQ ID NO: 12441
  hemagglutinin__InfluenzaA__ALE31795

SEQ ID NO: 13317 - protein, 566 aa, Artificial Sequence; identical to SEQ ID NO: 12441
  hemagglutinin__InfluenzaA__ALE31796

SEQ ID NO: 13318 - protein, 566 aa, Artificial Sequence; identical to SEQ ID NO: 13099
  hemagglutinin__InfluenzaA__ALE31797

SEQ ID NO: 13319 - protein, 566 aa, Artificial Sequence; identical to SEQ ID NO: 13099
  hemagglutinin__InfluenzaA__ALE31798

SEQ ID NO: 13320 - protein, 566 aa, Artificial Sequence; identical to SEQ ID NO: 12441
  hemagglutinin__InfluenzaA__ALE31799

SEQ ID NO: 13321 - protein, 566 aa, Artificial Sequence; identical to SEQ ID NO: 13047
  hemagglutinin__InfluenzaA__ALE31800

SEQ ID NO: 13322 - protein, 566 aa, Artificial Sequence; identical to SEQ ID NO: 12441
  hemagglutinin__InfluenzaA__ALE31801

SEQ ID NO: 13323 - protein, 566 aa, Artificial Sequence; identical to SEQ ID NO: 12441
  hemagglutinin__InfluenzaA__ALE31802

SEQ ID NO: 13324 - protein, 566 aa, Artificial Sequence; identical to SEQ ID NO: 13047
  hemagglutinin__InfluenzaA__ALE31803

SEQ ID NO: 13325 - protein, 566 aa, Artificial Sequence; identical to SEQ ID NO: 12998
  hemagglutinin__InfluenzaA__ALE31805

SEQ ID NO: 13326 - protein, 566 aa, Artificial Sequence
  hemagglutinin__InfluenzaA__ALE31806
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDTLLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13327 - protein, 566 aa, Artificial Sequence
  hemagglutinin__InfluenzaA__ALE31807
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNFTYPALNVTMPNNEQFDKLYVWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13328 - protein, 566 aa, Artificial Sequence
  hemagglutinin__InfluenzaA__ALE31808
MKTIIALGYILCLVFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13329 - protein, 566 aa, Artificial Sequence; identical to SEQ ID NO: 12441
  hemagglutinin__InfluenzaA__ALE31810

SEQ ID NO: 13330 - protein, 566 aa, Artificial Sequence; identical to SEQ ID NO: 12441
  hemagglutinin__InfluenzaA__ALE31812

SEQ ID NO: 13331 - protein, 566 aa, Artificial Sequence
  hemagglutinin__InfluenzaA__ALE31814
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKKWDLFVERSKAHSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQPSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13332 - protein, 566 aa, Artificial Sequence; identical to SEQ ID NO: 13331
  hemagglutinin__InfluenzaA__ALE31815

SEQ ID NO: 13333 - protein, 566 aa, Artificial Sequence; identical to SEQ ID NO: 12441
  hemagglutinin__InfluenzaA__ALE31818

SEQ ID NO: 13334 - protein, 566 aa, Artificial Sequence
  hemagglutinin__InfluenzaA__ALE31819
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSSSSFFSRLNWLTHLNYTYPALNVTMPNKEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13335 - protein, 566 aa, Artificial Sequence; identical to SEQ ID NO: 12985
  hemagglutinin__InfluenzaA__ALE31820

SEQ ID NO: 13336 - protein, 566 aa, Artificial Sequence
  hemagglutinin__InfluenzaA__ALE31821
MKTIIALSYTLCLVFAQKIPGNDNSTATLCLGHHAVPNGTIVKTITNDRIEVTNATELVQNSSIGEICDSPHQILDGENCTLIDALLGDPQCDGFQNKKWDLFVERSKAHSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13337 - protein, 566 aa, Artificial Sequence; identical to SEQ ID NO: 13077
  hemagglutinin__InfluenzaA__ALE31822

SEQ ID NO: 13338 - protein, 566 aa, Artificial Sequence; identical to SEQ ID NO: 12985
  hemagglutinin__InfluenzaA__ALE31823

SEQ ID NO: 13339 - protein, 566 aa, Artificial Sequence; identical to SEQ ID NO: 12441
  hemagglutinin__InfluenzaA__ALE31824

SEQ ID NO: 13340 - protein, 566 aa, Artificial Sequence
  hemagglutinin__InfluenzaA__ALE31825
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYRYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13341 - protein, 566 aa, Artificial Sequence; identical to SEQ ID NO: 12441
  hemagglutinin__InfluenzaA__ALE31826

SEQ ID NO: 13342 - protein, 566 aa, Artificial Sequence; identical to SEQ ID NO: 12441
  hemagglutinin__InfluenzaA__ALE31827

SEQ ID NO: 13343 - protein, 566 aa, Artificial Sequence; identical to SEQ ID NO: 12441
  hemagglutinin__InfluenzaA__ALE31828

SEQ ID NO: 13344 - protein, 566 aa, Artificial Sequence; identical to SEQ ID NO: 12998
  hemagglutinin__InfluenzaA__ALE31829

SEQ ID NO: 13345 - protein, 566 aa, Artificial Sequence
  hemagglutinin__InfluenzaA__ALE31830
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDITDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13346 - protein, 566 aa, Artificial Sequence
  hemagglutinin__InfluenzaA__ALE31832
MKNIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13347 - protein, 566 aa, Artificial Sequence
  hemagglutinin__InfluenzaA__ALE31833
MKTIIALSYILCLVSAQKIPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13348 - protein, 566 aa, Artificial Sequence
  hemagglutinin__InfluenzaA__ALE31834
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAHSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13349 - protein, 566 aa, Artificial Sequence; identical to SEQ ID NO: 13099
  hemagglutinin__InfluenzaA__ALE31835

SEQ ID NO: 13350 - protein, 566 aa, Artificial Sequence; identical to SEQ ID NO: 12441
  hemagglutinin__InfluenzaA__ALE31836

SEQ ID NO: 13351 - protein, 566 aa, Artificial Sequence
  hemagglutinin__InfluenzaA__ALE31837
MKTIIALSYILCLVYAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13352 - protein, 566 aa, Artificial Sequence; identical to SEQ ID NO: 12441
  hemagglutinin__InfluenzaA__ALE31838

SEQ ID NO: 13353 - protein, 566 aa, Artificial Sequence; identical to SEQ ID NO: 12441
  hemagglutinin__InfluenzaA__ALE31839

SEQ ID NO: 13354 - protein, 566 aa, Artificial Sequence
  hemagglutinin__InfluenzaA__ALE31840
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRLRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13355 - protein, 566 aa, Artificial Sequence; identical to SEQ ID NO: 12441
  hemagglutinin__InfluenzaA__ALE31842

SEQ ID NO: 13356 - protein, 566 aa, Artificial Sequence
  hemagglutinin__InfluenzaA__ALE31843
MQTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKILSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13357 - protein, 566 aa, Artificial Sequence; identical to SEQ ID NO: 12998
  hemagglutinin__InfluenzaA__ALE31844

SEQ ID NO: 13358 - protein, 566 aa, Artificial Sequence; identical to SEQ ID NO: 12974
  hemagglutinin__InfluenzaA__ALE31846

SEQ ID NO: 13359 - protein, 566 aa, Artificial Sequence; identical to SEQ ID NO: 12441
  hemagglutinin__InfluenzaA__ALE31847

SEQ ID NO: 13360 - protein, 566 aa, Artificial Sequence; identical to SEQ ID NO: 12441
  hemagglutinin__InfluenzaA__ALE31848

SEQ ID NO: 13361 - protein, 566 aa, Artificial Sequence
  hemagglutinin__InfluenzaA__ALE31850
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQPSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRVTYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13362 - protein, 566 aa, Artificial Sequence
  hemagglutinin__InfluenzaA__ALE31851
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSIGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13363 - protein, 566 aa, Artificial Sequence; identical to SEQ ID NO: 12985
  hemagglutinin__InfluenzaA__ALE31852

SEQ ID NO: 13364 - protein, 566 aa, Artificial Sequence
  hemagglutinin__InfluenzaA__ALE31853
MKTIIALSYILCLVFTQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13365 - protein, 566 aa, Artificial Sequence
  hemagglutinin__InfluenzaA__ALE31854
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYARSSGRITVSTKGSQQAVIPNIGSRPRIRDIPSRISIYWTIVKPGDILLINSTGNLIAPRGYFKIRSGKSSIMRSDAPIGRCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13366 - protein, 566 aa, Artificial Sequence; identical to SEQ ID NO: 13127
  hemagglutinin__InfluenzaA__ALE31855

SEQ ID NO: 13367 - protein, 566 aa, Artificial Sequence; identical to SEQ ID NO: 12441
  hemagglutinin__InfluenzaA__ALE31856

SEQ ID NO: 13368 - protein, 566 aa, Artificial Sequence; identical to SEQ ID NO: 12441
  hemagglutinin__InfluenzaA__ALE31857

SEQ ID NO: 13369 - protein, 566 aa, Artificial Sequence
  hemagglutinin__InfluenzaA__ALE31858
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLKYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13370 - protein, 566 aa, Artificial Sequence
  hemagglutinin__InfluenzaA__ALE31859
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACTRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDMLLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13371 - protein, 566 aa, Artificial Sequence
  hemagglutinin__InfluenzaA__ALE31860
MKTIIALSYILCLVFAQKIPGNDNSTATLCLGHHAVPNGTIVKTITNDRIEVTNATELVQNSSIGKICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGESSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13372 - protein, 566 aa, Artificial Sequence; identical to SEQ ID NO: 12441
  hemagglutinin__InfluenzaA__ALE31861

SEQ ID NO: 13373 - protein, 566 aa, Artificial Sequence
  hemagglutinin__InfluenzaA__ALE31862
MKMIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAEFLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13374 - protein, 566 aa, Artificial Sequence; identical to SEQ ID NO: 13099
  hemagglutinin__InfluenzaA__ALE31863

SEQ ID NO: 13375 - protein, 566 aa, Artificial Sequence; identical to SEQ ID NO: 13099
  hemagglutinin__InfluenzaA__ALE31865

SEQ ID NO: 13376 - protein, 566 aa, Artificial Sequence; identical to SEQ ID NO: 13099
  hemagglutinin__InfluenzaA__ALE31866

SEQ ID NO: 13377 - protein, 566 aa, Artificial Sequence
  hemagglutinin__InfluenzaA__ALE31867
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQNGNIRCNICI

SEQ ID NO: 13378 - protein, 566 aa, Artificial Sequence; identical to SEQ ID NO: 12441
  hemagglutinin__InfluenzaA__ALE31868

SEQ ID NO: 13379 - protein, 566 aa, Artificial Sequence; identical to SEQ ID NO: 13377
  hemagglutinin__InfluenzaA__ALE31869

SEQ ID NO: 13380 - protein, 566 aa, Artificial Sequence; identical to SEQ ID NO: 13377
  hemagglutinin__InfluenzaA__ALE31870

SEQ ID NO: 13381 - protein, 566 aa, Artificial Sequence
  hemagglutinin__InfluenzaA__ALE31871
MKTIIALSYILCLVFAQKIPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13382 - protein, 566 aa, Artificial Sequence; identical to SEQ ID NO: 12427
  hemagglutinin__InfluenzaA__ALE31872

SEQ ID NO: 13383 - protein, 566 aa, Artificial Sequence; identical to SEQ ID NO: 12441
  hemagglutinin__InfluenzaA__ALE31873

SEQ ID NO: 13384 - protein, 566 aa, Artificial Sequence
  hemagglutinin__InfluenzaA__ALE31874
MKTIIALSYILCLVFAQKLPGNDNSAATLCLGHHAVPNGTIVKTITNDRIEVTNATELVQNSSIGEICDSPHQILDGENCTLIDALLGDPQCDGFQNKKWDLFVERSKAHSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13385 - protein, 566 aa, Artificial Sequence; identical to SEQ ID NO: 13384
  hemagglutinin__InfluenzaA__ALE31875

SEQ ID NO: 13386 - protein, 566 aa, Artificial Sequence; identical to SEQ ID NO: 13384
  hemagglutinin__InfluenzaA__ALE31876

SEQ ID NO: 13387 - protein, 566 aa, Artificial Sequence
  hemagglutinin__InfluenzaA__ALE31877
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEINKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13388 - protein, 566 aa, Artificial Sequence; identical to SEQ ID NO: 12441
  hemagglutinin__InfluenzaA__ALE31878

SEQ ID NO: 13389 - protein, 566 aa, Artificial Sequence; identical to SEQ ID NO: 12441
  hemagglutinin__InfluenzaA__ALE31879

SEQ ID NO: 13390 - protein, 566 aa, Artificial Sequence; identical to SEQ ID NO: 12441
  hemagglutinin__InfluenzaA__ALE31880

SEQ ID NO: 13391 - protein, 566 aa, Artificial Sequence
  hemagglutinin__InfluenzaA__ALE31881
MKTIIALSHILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLVAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGIELKSGYKDWILWISFAISCFLLCVALLGFIMWACQKGNIRCNICI

SEQ ID NO: 13392 - protein, 566 aa, Artificial Sequence; identical to SEQ ID NO: 12441
  hemagglutinin__InfluenzaA__ALE31882

SEQ ID NO: 13393 - protein, 566 aa, Artificial Sequence; identical to SEQ ID NO: 12441
  hemagglutinin__InfluenzaA__ALE31888

SEQ ID NO: 13394 - protein, 566 aa, Artificial Sequence; identical to SEQ ID NO: 12441
  hemagglutinin__InfluenzaA__ALE31889

SEQ ID NO: 13395 - protein, 566 aa, Artificial Sequence; identical to SEQ ID NO: 13099
  hemagglutinin__InfluenzaA__ALE31890

SEQ ID NO: 13396 - protein, 566 aa, Artificial Sequence; identical to SEQ ID NO: 13099
  hemagglutinin__InfluenzaA__ALE31891

SEQ ID NO: 13397 - protein, 566 aa, Artificial Sequence; identical to SEQ ID NO: 12441
  hemagglutinin__InfluenzaA__ALE31892

SEQ ID NO: 13398 - protein, 566 aa, Artificial Sequence; identical to SEQ ID NO: 12441
  hemagglutinin__InfluenzaA__ALE31893

SEQ ID NO: 13399 - protein, 566 aa, Artificial Sequence; identical to SEQ ID NO: 13047
  hemagglutinin__InfluenzaA__ALE31894

SEQ ID NO: 13400 - protein, 566 aa, Artificial Sequence; identical to SEQ ID NO: 12427
  hemagglutinin__InfluenzaA__ALE31895

SEQ ID NO: 13401 - protein, 566 aa, Artificial Sequence; identical to SEQ ID NO: 12441
  hemagglutinin__InfluenzaA__ALE31896

SEQ ID NO: 13402 - protein, 566 aa, Artificial Sequence; identical to SEQ ID NO: 12441
  hemagglutinin__InfluenzaA__ALE31897

SEQ ID NO: 13403 - protein, 566 aa, Artificial Sequence; identical to SEQ ID NO: 12441
  hemagglutinin__InfluenzaA__ALE31898

SEQ ID NO: 13404 - protein, 566 aa, Artificial Sequence
  hemagglutinin__InfluenzaA__ALE31899
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSMMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13405 - protein, 566 aa, Artificial Sequence; identical to SEQ ID NO: 13047
  hemagglutinin__InfluenzaA__ALE31901

SEQ ID NO: 13406 - protein, 566 aa, Artificial Sequence
  hemagglutinin__InfluenzaA__ALE31902
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13407 - protein, 566 aa, Artificial Sequence; identical to SEQ ID NO: 12441
  hemagglutinin__InfluenzaA__ALE31903

SEQ ID NO: 13408 - protein, 566 aa, Artificial Sequence; identical to SEQ ID NO: 12441
  hemagglutinin__InfluenzaA__ALE31904

SEQ ID NO: 13409 - protein, 566 aa, Artificial Sequence
  hemagglutinin__InfluenzaA__ALE31905
MKTIIALGYILCLGFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13410 - protein, 566 aa, Artificial Sequence; identical to SEQ ID NO: 12441
  hemagglutinin__InfluenzaA__ALE31906

SEQ ID NO: 13411 - protein, 566 aa, Artificial Sequence
  hemagglutinin__InfluenzaA__ALE31907
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFLYAQSSGRITVSTKRSQQAVIPNIGSRPRIRDIPSRISIYWTIVKSGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13412 - protein, 566 aa, Artificial Sequence; identical to SEQ ID NO: 12441
  hemagglutinin__InfluenzaA__ALE31908

SEQ ID NO: 13413 - protein, 566 aa, Artificial Sequence
  hemagglutinin__InfluenzaA__ALE31909
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKSGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13414 - protein, 566 aa, Artificial Sequence; identical to SEQ ID NO: 12441
  hemagglutinin__InfluenzaA__ALE31910

SEQ ID NO: 13415 - protein, 566 aa, Artificial Sequence; identical to SEQ ID NO: 13364
  hemagglutinin__InfluenzaA__ALE31912

SEQ ID NO: 13416 - protein, 566 aa, Artificial Sequence
  hemagglutinin__InfluenzaA__ALE31913
MKTIIALGYILCLVFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIESIRNGTYDHNVYRDEALNNRFQIKGVELKSGYKDWILWISFAISCFLLCVALLGFIMWACQKGNIRCNICI

SEQ ID NO: 13417 - protein, 566 aa, Artificial Sequence; identical to SEQ ID NO: 12441
  hemagglutinin__InfluenzaA__ALE31914

SEQ ID NO: 13418 - protein, 566 aa, Artificial Sequence
  hemagglutinin__InfluenzaA__ALE31915
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPEYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13419 - protein, 566 aa, Artificial Sequence; identical to SEQ ID NO: 12441
  hemagglutinin__InfluenzaA__ALE31916

SEQ ID NO: 13420 - protein, 566 aa, Artificial Sequence; identical to SEQ ID NO: 12441
  hemagglutinin__InfluenzaA__ALE31917

SEQ ID NO: 13421 - protein, 566 aa, Artificial Sequence; identical to SEQ ID NO: 12974
  hemagglutinin__InfluenzaA__ALE31918

SEQ ID NO: 13422 - protein, 566 aa, Artificial Sequence; identical to SEQ ID NO: 13099
  hemagglutinin__InfluenzaA__ALE31920

SEQ ID NO: 13423 - protein, 566 aa, Artificial Sequence; identical to SEQ ID NO: 12441
  hemagglutinin__InfluenzaA__ALE31921

SEQ ID NO: 13424 - protein, 566 aa, Artificial Sequence; identical to SEQ ID NO: 12441
  hemagglutinin__InfluenzaA__ALE31922

SEQ ID NO: 13425 - protein, 566 aa, Artificial Sequence; identical to SEQ ID NO: 12985
  hemagglutinin__InfluenzaA__ALE31923

SEQ ID NO: 13426 - protein, 566 aa, Artificial Sequence; identical to SEQ ID NO: 12441
  hemagglutinin__InfluenzaA__ALE31924

SEQ ID NO: 13427 - protein, 566 aa, Artificial Sequence; identical to SEQ ID NO: 12441
  hemagglutinin__InfluenzaA__ALE31925

SEQ ID NO: 13428 - protein, 566 aa, Artificial Sequence
  hemagglutinin__InfluenzaA__ALE31926
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNEGFNWTGVTQNGTSSACIRRSSSSFFSRLNWLTHLNYKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13429 - protein, 566 aa, Artificial Sequence; identical to SEQ ID NO: 12441
  hemagglutinin__InfluenzaA__ALE31927

SEQ ID NO: 13430 - protein, 566 aa, Artificial Sequence
  hemagglutinin__InfluenzaA__ALE31928
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13431 - protein, 566 aa, Artificial Sequence; identical to SEQ ID NO: 13077
  hemagglutinin__InfluenzaA__ALE31930

SEQ ID NO: 13432 - protein, 566 aa, Artificial Sequence; identical to SEQ ID NO: 12441
  hemagglutinin__InfluenzaA__ALE31931

SEQ ID NO: 13433 - protein, 566 aa, Artificial Sequence; identical to SEQ ID NO: 12441
  hemagglutinin__InfluenzaA__ALE31932

SEQ ID NO: 13434 - protein, 566 aa, Artificial Sequence
  hemagglutinin__InfluenzaA__ALE31933
MKTIIALSYILCLVYAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLKYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13435 - protein, 566 aa, Artificial Sequence
  hemagglutinin__InfluenzaA__ALE31934
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYQALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNIPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13436 - protein, 566 aa, Artificial Sequence; identical to SEQ ID NO: 12441
  hemagglutinin__InfluenzaA__ALE31935

SEQ ID NO: 13437 - protein, 566 aa, Artificial Sequence; identical to SEQ ID NO: 13223
  hemagglutinin__InfluenzaA__ALE31936

SEQ ID NO: 13438 - protein, 566 aa, Artificial Sequence
  hemagglutinin__InfluenzaA__ALE31937
MKTIIALSYILCLVFAQKLPENDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQPSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13439 - protein, 566 aa, Artificial Sequence; identical to SEQ ID NO: 12441
  hemagglutinin__InfluenzaA__ALE31938

SEQ ID NO: 13440 - protein, 566 aa, Artificial Sequence; identical to SEQ ID NO: 13047
  hemagglutinin__InfluenzaA__ALE31939

SEQ ID NO: 13441 - protein, 566 aa, Artificial Sequence; identical to SEQ ID NO: 12441
  hemagglutinin__InfluenzaA__ALE31941

SEQ ID NO: 13442 - protein, 566 aa, Artificial Sequence; identical to SEQ ID NO: 12998
  hemagglutinin__InfluenzaA__ALE31943

SEQ ID NO: 13443 - protein, 566 aa, Artificial Sequence
  hemagglutinin__InfluenzaA__ALE31944
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13444 - protein, 566 aa, Artificial Sequence
  hemagglutinin__InfluenzaA__ALE31945
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKGSQQAVIPNVGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDIEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13445 - protein, 566 aa, Artificial Sequence; identical to SEQ ID NO: 13099
  hemagglutinin__InfluenzaA__ALE31946

SEQ ID NO: 13446 - protein, 566 aa, Artificial Sequence; identical to SEQ ID NO: 13099
  hemagglutinin__InfluenzaA__ALE31947

SEQ ID NO: 13447 - protein, 566 aa, Artificial Sequence
  hemagglutinin__InfluenzaA__ALE31948
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLVGKTNEKFHQIEKEFSEVEGRIQDLEKYVEDTKIDLWSYNAEFLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13448 - protein, 566 aa, Artificial Sequence; identical to SEQ ID NO: 13099
  hemagglutinin__InfluenzaA__ALE31949

SEQ ID NO: 13449 - protein, 566 aa, Artificial Sequence; identical to SEQ ID NO: 12441
  hemagglutinin__InfluenzaA__ALE31950

SEQ ID NO: 13450 - protein, 566 aa, Artificial Sequence; identical to SEQ ID NO: 12985
  hemagglutinin__InfluenzaA__ALE31951

SEQ ID NO: 13451 - protein, 566 aa, Artificial Sequence; identical to SEQ ID NO: 12441
  hemagglutinin__InfluenzaA__ALE31952

SEQ ID NO: 13452 - protein, 566 aa, Artificial Sequence
  hemagglutinin__InfluenzaA__ALE31953
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLFARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13453 - protein, 566 aa, Artificial Sequence
  hemagglutinin__InfluenzaA__ALE31954
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKRWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAHSSGRITVSTKRSQQAVIPNVGSRPRIRNIPSRISIYWTIVKPGDILLINSTGNLIAPRGYFKIQSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLVGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHYVYRDEALNNRFQIKGVELKSGYKDWILWISFAISCFLLCVALLGFIMWACQKGNIRCNICI

SEQ ID NO: 13454 - protein, 566 aa, Artificial Sequence; identical to SEQ ID NO: 12441
  hemagglutinin__InfluenzaA__ALE31955

SEQ ID NO: 13455 - protein, 566 aa, Artificial Sequence
  hemagglutinin__InfluenzaA__ALE31956
MKTIIALSYILCLVFAQKIPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13456 - protein, 566 aa, Artificial Sequence; identical to SEQ ID NO: 13047
  hemagglutinin__InfluenzaA__ALE31957

SEQ ID NO: 13457 - protein, 566 aa, Artificial Sequence
  hemagglutinin__InfluenzaA__ALE31958
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSKPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13458 - protein, 566 aa, Artificial Sequence
  hemagglutinin__InfluenzaA__ALE31959
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYAYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13459 - protein, 566 aa, Artificial Sequence; identical to SEQ ID NO: 12441
  hemagglutinin__InfluenzaA__ALE31960

SEQ ID NO: 13460 - protein, 566 aa, Artificial Sequence; identical to SEQ ID NO: 12630
  hemagglutinin__InfluenzaA__ALE31961

SEQ ID NO: 13461 - protein, 566 aa, Artificial Sequence
  hemagglutinin__InfluenzaA__ALE31962
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRMSIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13462 - protein, 566 aa, Artificial Sequence
  hemagglutinin__InfluenzaA__ALE31963
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQTFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHNVYRDEALNNRFQIKGVELKSGYKDWILWISFAISCFLLCVALLGFIMWACQKGNIRCNICI

SEQ ID NO: 13463 - protein, 566 aa, Artificial Sequence
  hemagglutinin__InfluenzaA__ALE31964
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYYVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIQSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13464 - protein, 566 aa, Artificial Sequence; identical to SEQ ID NO: 12441
  hemagglutinin__InfluenzaA__ALE31965

SEQ ID NO: 13465 - protein, 566 aa, Artificial Sequence; identical to SEQ ID NO: 13099
  hemagglutinin__InfluenzaA__ALE31966

SEQ ID NO: 13466 - protein, 566 aa, Artificial Sequence; identical to SEQ ID NO: 13369
  hemagglutinin__InfluenzaA__ALE31967

SEQ ID NO: 13467 - protein, 566 aa, Artificial Sequence; identical to SEQ ID NO: 12985
  hemagglutinin__InfluenzaA__ALE31968

SEQ ID NO: 13468 - protein, 566 aa, Artificial Sequence; identical to SEQ ID NO: 13092
  hemagglutinin__InfluenzaA__ALE31969

SEQ ID NO: 13469 - protein, 566 aa, Artificial Sequence; identical to SEQ ID NO: 12441
  hemagglutinin__InfluenzaA__ALE31970

SEQ ID NO: 13470 - protein, 566 aa, Artificial Sequence
  hemagglutinin__InfluenzaA__ALE31971
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYAYPALNVTMPNNEQFDKLYIWGVHHPGTDKDQIFLYAQSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13471 - protein, 566 aa, Artificial Sequence; identical to SEQ ID NO: 12985
  hemagglutinin__InfluenzaA__ALE31972

SEQ ID NO: 13472 - protein, 566 aa, Artificial Sequence; identical to SEQ ID NO: 12985
  hemagglutinin__InfluenzaA__ALE31973

SEQ ID NO: 13473 - protein, 566 aa, Artificial Sequence; identical to SEQ ID NO: 12630
  hemagglutinin__InfluenzaA__ALE31974

SEQ ID NO: 13474 - protein, 566 aa, Artificial Sequence; identical to SEQ ID NO: 12985
  hemagglutinin__InfluenzaA__ALE31975

SEQ ID NO: 13475 - protein, 566 aa, Artificial Sequence; identical to SEQ ID NO: 12441
  hemagglutinin__InfluenzaA__ALE31976

SEQ ID NO: 13476 - protein, 566 aa, Artificial Sequence; identical to SEQ ID NO: 12441
  hemagglutinin__InfluenzaA__ALE31977

SEQ ID NO: 13477 - protein, 566 aa, Artificial Sequence
  hemagglutinin__InfluenzaA__ALE31978
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLIHSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13478 - protein, 566 aa, Artificial Sequence; identical to SEQ ID NO: 12441
  hemagglutinin__InfluenzaA__ALE31979

SEQ ID NO: 13479 - protein, 566 aa, Artificial Sequence
  hemagglutinin__InfluenzaA__ALE31980
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSEYKDWILWISFAISCFLLCVALLGFIMWACQKGNIRCNICI

SEQ ID NO: 13480 - protein, 566 aa, Artificial Sequence; identical to SEQ ID NO: 12441
  hemagglutinin__InfluenzaA__ALE31981

SEQ ID NO: 13481 - protein, 566 aa, Artificial Sequence; identical to SEQ ID NO: 12981
  hemagglutinin__InfluenzaA__ALE31995

SEQ ID NO: 13482 - protein, 566 aa, Artificial Sequence
  hemagglutinin__InfluenzaA__ALE31996
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRVTYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13483 - protein, 566 aa, Artificial Sequence
  hemagglutinin__InfluenzaA__ALE31997
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFIERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13484 - protein, 566 aa, Artificial Sequence; identical to SEQ ID NO: 12441
  hemagglutinin__InfluenzaA__ALE31998

SEQ ID NO: 13485 - protein, 566 aa, Artificial Sequence
  hemagglutinin__InfluenzaA__ALE31999
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLHYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13486 - protein, 566 aa, Artificial Sequence
  hemagglutinin__InfluenzaA__ALE32000
MKTIIALSHILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13487 - protein, 566 aa, Artificial Sequence; identical to SEQ ID NO: 12441
  hemagglutinin__InfluenzaA__ALE32001

SEQ ID NO: 13488 - protein, 566 aa, Artificial Sequence; identical to SEQ ID NO: 12441
  hemagglutinin__InfluenzaA__ALE32002

SEQ ID NO: 13489 - protein, 566 aa, Artificial Sequence; identical to SEQ ID NO: 12541
  hemagglutinin__InfluenzaA__ALE32003

SEQ ID NO: 13490 - protein, 566 aa, Artificial Sequence; identical to SEQ ID NO: 12441
  hemagglutinin__InfluenzaA__ALE32004

SEQ ID NO: 13491 - protein, 566 aa, Artificial Sequence; identical to SEQ ID NO: 12441
  hemagglutinin__InfluenzaA__ALE32005

SEQ ID NO: 13492 - protein, 566 aa, Artificial Sequence; identical to SEQ ID NO: 12985
  hemagglutinin__InfluenzaA__ALE32006

SEQ ID NO: 13493 - protein, 566 aa, Artificial Sequence; identical to SEQ ID NO: 12441
  hemagglutinin__InfluenzaA__ALE32007

SEQ ID NO: 13494 - protein, 566 aa, Artificial Sequence; identical to SEQ ID NO: 12992
  hemagglutinin__InfluenzaA__ALE32008

SEQ ID NO: 13495 - protein, 566 aa, Artificial Sequence
  hemagglutinin__InfluenzaA__ALE32009
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIVLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQEGNIRCNICI

SEQ ID NO: 13496 - protein, 566 aa, Artificial Sequence
  hemagglutinin__InfluenzaA__ALE32010
MKTIIALSYILCLAFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLHYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13497 - protein, 566 aa, Artificial Sequence; identical to SEQ ID NO: 13455
  hemagglutinin__InfluenzaA__ALE32011

SEQ ID NO: 13498 - protein, 566 aa, Artificial Sequence; identical to SEQ ID NO: 12998
  hemagglutinin__InfluenzaA__ALE32012

SEQ ID NO: 13499 - protein, 566 aa, Artificial Sequence; identical to SEQ ID NO: 12441
  hemagglutinin__InfluenzaA__ALE32013

SEQ ID NO: 13500 - protein, 566 aa, Artificial Sequence
  hemagglutinin__InfluenzaA__ALE32014
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTQLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13501 - protein, 566 aa, Artificial Sequence; identical to SEQ ID NO: 13326
  hemagglutinin__InfluenzaA__ALE32015

SEQ ID NO: 13502 - protein, 566 aa, Artificial Sequence; identical to SEQ ID NO: 12441
  hemagglutinin__InfluenzaA__ALE32016

SEQ ID NO: 13503 - protein, 566 aa, Artificial Sequence; identical to SEQ ID NO: 12441
  hemagglutinin__InfluenzaA__ALE32017

SEQ ID NO: 13504 - protein, 566 aa, Artificial Sequence; identical to SEQ ID NO: 12441
  hemagglutinin__InfluenzaA__ALE32018

SEQ ID NO: 13505 - protein, 566 aa, Artificial Sequence; identical to SEQ ID NO: 12985
  hemagglutinin__InfluenzaA__ALE32020

SEQ ID NO: 13506 - protein, 566 aa, Artificial Sequence; identical to SEQ ID NO: 13092
  hemagglutinin__InfluenzaA__ALE32021

SEQ ID NO: 13507 - protein, 566 aa, Artificial Sequence; identical to SEQ ID NO: 13172
  hemagglutinin__InfluenzaA__ALE32022

SEQ ID NO: 13508 - protein, 566 aa, Artificial Sequence; identical to SEQ ID NO: 12441
  hemagglutinin__InfluenzaA__ALE32023

SEQ ID NO: 13509 - protein, 566 aa, Artificial Sequence
  hemagglutinin__InfluenzaA__ALE32024
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKRWDLFVERSKAYSNCYPYDVPDYASLRSLVASSGTLEFNDESFNWAGVTQNGKSSACIRGSNSSFFSRLNWLTHSNFKYPALNVTMPNNEQFDKLYIWGVHHPGTDKDQIFLYAHSSGRITVSTKRSQQAVIPNIGSRPRIRNIPSRISIYWTIVKPGDILLINSTGNLIAPRGYFKIQSGKSSIMRSDAPIGKCKSECITPNGSIPNDKPFQNVNRITYGTCPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHYVYRDEALNNRFQIKGVELKSGYKDWILWISFAISCFLLCVALLGFIMWACQKGNIRCNICI

SEQ ID NO: 13510 - protein, 566 aa, Artificial Sequence
  hemagglutinin__InfluenzaA__ALE32025
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKSGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMSKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13511 - protein, 566 aa, Artificial Sequence; identical to SEQ ID NO: 12441
  hemagglutinin__InfluenzaA__ALE32026

SEQ ID NO: 13512 - protein, 566 aa, Artificial Sequence; identical to SEQ ID NO: 12985
  hemagglutinin__InfluenzaA__ALE32027

SEQ ID NO: 13513 - protein, 566 aa, Artificial Sequence
  hemagglutinin__InfluenzaA__ALE32028
MKTIIALSHILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13514 - protein, 566 aa, Artificial Sequence; identical to SEQ ID NO: 13092
  hemagglutinin__InfluenzaA__ALE32029

SEQ ID NO: 13515 - protein, 566 aa, Artificial Sequence
  hemagglutinin__InfluenzaA__ALE32030
MKTIIALSHILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYIYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13516 - protein, 566 aa, Artificial Sequence
  hemagglutinin__InfluenzaA__ALE32031
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13517 - protein, 566 aa, Artificial Sequence
  hemagglutinin__InfluenzaA__ALE32032
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRIAVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13518 - protein, 566 aa, Artificial Sequence; identical to SEQ ID NO: 12441
  hemagglutinin__InfluenzaA__ALE32033

SEQ ID NO: 13519 - protein, 566 aa, Artificial Sequence
  hemagglutinin__InfluenzaA__ALE32034
MKTIIALGYILCLVFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLKYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13520 - protein, 566 aa, Artificial Sequence; identical to SEQ ID NO: 13331
  hemagglutinin__InfluenzaA__ALE32035

SEQ ID NO: 13521 - protein, 566 aa, Artificial Sequence
  hemagglutinin__InfluenzaA__ALE32036
MKTIIALGYILCLVFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLHYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13522 - protein, 566 aa, Artificial Sequence
  hemagglutinin__InfluenzaA__ALE32037
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKILSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13523 - protein, 566 aa, Artificial Sequence
  hemagglutinin__InfluenzaA__ALE32038
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSKGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHLNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13524 - protein, 566 aa, Artificial Sequence; identical to SEQ ID NO: 13099
  hemagglutinin__InfluenzaA__ALE32039

SEQ ID NO: 13525 - protein, 566 aa, Artificial Sequence
  hemagglutinin__InfluenzaA__ALE32040
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGTSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13526 - protein, 566 aa, Artificial Sequence; identical to SEQ ID NO: 12441
  hemagglutinin__InfluenzaA__ALE32041

SEQ ID NO: 13527 - protein, 566 aa, Artificial Sequence; identical to SEQ ID NO: 12441
  hemagglutinin__InfluenzaA__ALE32042

SEQ ID NO: 13528 - protein, 566 aa, Artificial Sequence
  hemagglutinin__InfluenzaA__ALE32043
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYTSLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13529 - protein, 566 aa, Artificial Sequence; identical to SEQ ID NO: 12441
  hemagglutinin__InfluenzaA__ALE32044

SEQ ID NO: 13530 - protein, 566 aa, Artificial Sequence; identical to SEQ ID NO: 12441
  hemagglutinin__InfluenzaA__ALE32045

SEQ ID NO: 13531 - protein, 566 aa, Artificial Sequence; identical to SEQ ID NO: 12441
  hemagglutinin__InfluenzaA__ALE32046

SEQ ID NO: 13532 - protein, 566 aa, Artificial Sequence
  hemagglutinin__InfluenzaA__ALE32047
MKTIIALSYILCLVFAQKIPGNDNSTATLCLGHHAVPNGTIVKTITNDRIEVTNATELVQNSSIGEICDSPHQVLDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMISDAPIGKCKSECITPNGSIPSDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13533 - protein, 566 aa, Artificial Sequence; identical to SEQ ID NO: 12441
  hemagglutinin__InfluenzaA__ALE32048

SEQ ID NO: 13534 - protein, 566 aa, Artificial Sequence; identical to SEQ ID NO: 13099
  hemagglutinin__InfluenzaA__ALE32049

SEQ ID NO: 13535 - protein, 566 aa, Artificial Sequence
  hemagglutinin__InfluenzaA__ALE32050
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQDGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13536 - protein, 566 aa, Artificial Sequence
  hemagglutinin__InfluenzaA__ALE32051
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRVTYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALINRFQIKGVELKSGYKDWILWISFAISCFLLCVALLGFIMWACQKGNIRCNICI

SEQ ID NO: 13537 - protein, 566 aa, Artificial Sequence; identical to SEQ ID NO: 12441
  hemagglutinin__InfluenzaA__ALE32052

SEQ ID NO: 13538 - protein, 566 aa, Artificial Sequence; identical to SEQ ID NO: 12441
  hemagglutinin__InfluenzaA__ALE32053

SEQ ID NO: 13539 - protein, 566 aa, Artificial Sequence
  hemagglutinin__InfluenzaA__ALE32054
MKTIIALSYILCLVFAQKIPGNDNSTATLCLGHHAVPNGTIVKTITNDRIEVTNATELVQNSSIGEICESPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNHCI

SEQ ID NO: 13540 - protein, 566 aa, Artificial Sequence
  hemagglutinin__InfluenzaA__ALE32055
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQNGNIRCNICI

SEQ ID NO: 13541 - protein, 566 aa, Artificial Sequence; identical to SEQ ID NO: 13092
  hemagglutinin__InfluenzaA__ALE32056

SEQ ID NO: 13542 - protein, 566 aa, Artificial Sequence
  hemagglutinin__InfluenzaA__ALE32057
MKTIIALSYVLCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13543 - protein, 566 aa, Artificial Sequence; identical to SEQ ID NO: 12441
  hemagglutinin__InfluenzaA__ALE32058

SEQ ID NO: 13544 - protein, 566 aa, Artificial Sequence; identical to SEQ ID NO: 12441
  hemagglutinin__InfluenzaA__ALE32059

SEQ ID NO: 13545 - protein, 566 aa, Artificial Sequence
  hemagglutinin__InfluenzaA__ALE32060
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQVFLYAQSSGRITVSTKRSQQAVIPNIGSRPRIRDIPSRISIYWTIVKPGDILLIHSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13546 - protein, 566 aa, Artificial Sequence
  hemagglutinin__InfluenzaA__ALE32061
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLKYTYPALNVTMPNNEQFDKLYIWGVHHPGTDNDQIFLYARSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13547 - protein, 566 aa, Artificial Sequence
  hemagglutinin__InfluenzaA__ALE32062
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLIYSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13548 - protein, 566 aa, Artificial Sequence; identical to SEQ ID NO: 12441
  hemagglutinin__InfluenzaA__ALE32063

SEQ ID NO: 13549 - protein, 566 aa, Artificial Sequence
  hemagglutinin__InfluenzaA__ALE32064
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSNSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDIGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13550 - protein, 566 aa, Artificial Sequence; identical to SEQ ID NO: 12441
  hemagglutinin__InfluenzaA__ALE32065

SEQ ID NO: 13551 - protein, 566 aa, Artificial Sequence
  hemagglutinin__InfluenzaA__ALE32066
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVSMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13552 - protein, 566 aa, Artificial Sequence; identical to SEQ ID NO: 13223
  hemagglutinin__InfluenzaA__ALE32067

SEQ ID NO: 13553 - protein, 566 aa, Artificial Sequence; identical to SEQ ID NO: 12441
  hemagglutinin__InfluenzaA__ALE32068

SEQ ID NO: 13554 - protein, 566 aa, Artificial Sequence; identical to SEQ ID NO: 12441
  hemagglutinin__InfluenzaA__ALE32069

SEQ ID NO: 13555 - protein, 566 aa, Artificial Sequence
  hemagglutinin__InfluenzaA__ALE32070
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGVCPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13556 - protein, 566 aa, Artificial Sequence; identical to SEQ ID NO: 12441
  hemagglutinin__InfluenzaA__ALE32071

SEQ ID NO: 13557 - protein, 566 aa, Artificial Sequence; identical to SEQ ID NO: 13438
  hemagglutinin__InfluenzaA__ALE32072

SEQ ID NO: 13558 - protein, 566 aa, Artificial Sequence
  hemagglutinin__InfluenzaA__ALE32073
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKILSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13559 - protein, 566 aa, Artificial Sequence
  hemagglutinin__InfluenzaA__ALE32074
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSSCIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKILSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13560 - protein, 566 aa, Artificial Sequence
  hemagglutinin__InfluenzaA__ALE32075
MKTIIALSYILCLVFAQKLPENDNSTATLCLGHHAVPNGTIVKTITSDRIEVTNATELVQNSSIGEICDSPHQILDGKNCTLIDALLGDPQCDGFQNKKWDLFVERSKAYSNCYPYDVPDYASLRSLVASSGTLEFNDESFNWAGVTQNGTSSSCIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13561 - protein, 566 aa, Artificial Sequence; identical to SEQ ID NO: 12998
  hemagglutinin__InfluenzaA__ALE32076

SEQ ID NO: 13562 - protein, 566 aa, Artificial Sequence
  hemagglutinin__InfluenzaA__ALE32077
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAHSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYARSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13563 - protein, 566 aa, Artificial Sequence; identical to SEQ ID NO: 13099
  hemagglutinin__InfluenzaA__ALE32078

SEQ ID NO: 13564 - protein, 566 aa, Artificial Sequence; identical to SEQ ID NO: 12985
  hemagglutinin__InfluenzaA__ALE32079

SEQ ID NO: 13565 - protein, 566 aa, Artificial Sequence
  hemagglutinin__InfluenzaA__ALE32080
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSSCIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13566 - protein, 566 aa, Artificial Sequence; identical to SEQ ID NO: 13099
  hemagglutinin__InfluenzaA__ALE32081

SEQ ID NO: 13567 - protein, 566 aa, Artificial Sequence; identical to SEQ ID NO: 13099
  hemagglutinin__InfluenzaA__ALE32082

SEQ ID NO: 13568 - protein, 566 aa, Artificial Sequence
  hemagglutinin__InfluenzaA__ALE32083
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFLYARSSGRITVSTKGSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13569 - protein, 566 aa, Artificial Sequence; identical to SEQ ID NO: 13056
  hemagglutinin__InfluenzaA__ALE32084

SEQ ID NO: 13570 - protein, 566 aa, Artificial Sequence; identical to SEQ ID NO: 13099
  hemagglutinin__InfluenzaA__ALE32085

SEQ ID NO: 13571 - protein, 566 aa, Artificial Sequence
  hemagglutinin__InfluenzaA__ALE32086
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPISKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13572 - protein, 566 aa, Artificial Sequence
  hemagglutinin__InfluenzaA__ALE32087
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLDYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGNLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13573 - protein, 566 aa, Artificial Sequence
  hemagglutinin__InfluenzaA__ALE32088
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVLHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTVDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13574 - protein, 566 aa, Artificial Sequence; identical to SEQ ID NO: 12441
  hemagglutinin__InfluenzaA__ALE32089

SEQ ID NO: 13575 - protein, 566 aa, Artificial Sequence; identical to SEQ ID NO: 12441
  hemagglutinin__InfluenzaA__ALE32090

SEQ ID NO: 13576 - protein, 566 aa, Artificial Sequence; identical to SEQ ID NO: 12441
  hemagglutinin__InfluenzaA__ALE32091

SEQ ID NO: 13577 - protein, 566 aa, Artificial Sequence
  hemagglutinin__InfluenzaA__ALE32092
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCRSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYEHNVYRDEALNNRFQIKGVELKSGYKDWILWISFAISCFLLCVALLGFIMWACQKGNIRCNICI

SEQ ID NO: 13578 - protein, 566 aa, Artificial Sequence; identical to SEQ ID NO: 13047
  hemagglutinin__InfluenzaA__ALE32093

SEQ ID NO: 13579 - protein, 566 aa, Artificial Sequence
  hemagglutinin__InfluenzaA__ALE32094
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLITSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13580 - protein, 566 aa, Artificial Sequence; identical to SEQ ID NO: 12441
  hemagglutinin__InfluenzaA__ALE32095

SEQ ID NO: 13581 - protein, 566 aa, Artificial Sequence
  hemagglutinin__InfluenzaA__ALE32096
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLSYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13582 - protein, 566 aa, Artificial Sequence; identical to SEQ ID NO: 12441
  hemagglutinin__InfluenzaA__ALE32097

SEQ ID NO: 13583 - protein, 566 aa, Artificial Sequence; identical to SEQ ID NO: 13047
  hemagglutinin__InfluenzaA__ALE32099

SEQ ID NO: 13584 - protein, 566 aa, Artificial Sequence
  hemagglutinin__InfluenzaA__ALE32100
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNADLLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13585 - protein, 566 aa, Artificial Sequence
  hemagglutinin__InfluenzaA__ALE32101
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSQCYPYDVPDYASLRSLVASSGTLEFNNESFNWTGVTQNGTSSACIRKSSGSFFSRLNWLTHLKYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13586 - protein, 566 aa, Artificial Sequence
  hemagglutinin__InfluenzaA__ALE32102
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLKYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALSNRFQIKGVELKSGYKDWILWISFAISCFLLCVALLGFIMWACQKGNIRCNICI

SEQ ID NO: 13587 - protein, 566 aa, Artificial Sequence; identical to SEQ ID NO: 13154
  hemagglutinin__InfluenzaA__ALE32103

SEQ ID NO: 13588 - protein, 566 aa, Artificial Sequence
  hemagglutinin__InfluenzaA__ALE32104
MKTIIALSYILCLVFAQKIPGNDNSTATLCLGHHAVPNGTIVKTITNDQIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13589 - protein, 566 aa, Artificial Sequence; identical to SEQ ID NO: 13099
  hemagglutinin__InfluenzaA__ALE32105

SEQ ID NO: 13590 - protein, 566 aa, Artificial Sequence; identical to SEQ ID NO: 13099
  hemagglutinin__InfluenzaA__ALE32106

SEQ ID NO: 13591 - protein, 566 aa, Artificial Sequence; identical to SEQ ID NO: 13154
  hemagglutinin__InfluenzaA__ALE32107

SEQ ID NO: 13592 - protein, 566 aa, Artificial Sequence; identical to SEQ ID NO: 13384
  hemagglutinin__InfluenzaA__ALE32108

SEQ ID NO: 13593 - protein, 566 aa, Artificial Sequence; identical to SEQ ID NO: 12998
  hemagglutinin__InfluenzaA__ALE32109

SEQ ID NO: 13594 - protein, 566 aa, Artificial Sequence; identical to SEQ ID NO: 12985
  hemagglutinin__InfluenzaA__ALE32110

SEQ ID NO: 13595 - protein, 566 aa, Artificial Sequence; identical to SEQ ID NO: 12441
  hemagglutinin__InfluenzaA__ALE32111

SEQ ID NO: 13596 - protein, 566 aa, Artificial Sequence
  hemagglutinin__InfluenzaA__ALE32112
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYAYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13597 - protein, 566 aa, Artificial Sequence
  hemagglutinin__InfluenzaA__ALE32113
MKTIIALSYILCLVFAQKIPGNDNSTATLCLGHHAVPNGTVVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKMRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13598 - protein, 566 aa, Artificial Sequence; identical to SEQ ID NO: 12985
  hemagglutinin__InfluenzaA__ALE32114

SEQ ID NO: 13599 - protein, 566 aa, Artificial Sequence; identical to SEQ ID NO: 12985
  hemagglutinin__InfluenzaA__ALE32115

SEQ ID NO: 13600 - protein, 566 aa, Artificial Sequence
  hemagglutinin__InfluenzaA__ALE32116
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNVRCNICI

SEQ ID NO: 13601 - protein, 566 aa, Artificial Sequence
  hemagglutinin__InfluenzaA__ALE32117
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADFKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSEYKDWILWISFAISCFLLCVALLGFIMWACQKGNIRCNICI

SEQ ID NO: 13602 - protein, 566 aa, Artificial Sequence; identical to SEQ ID NO: 13047
  hemagglutinin__InfluenzaA__ALE32118

SEQ ID NO: 13603 - protein, 566 aa, Artificial Sequence; identical to SEQ ID NO: 2669
  hemagglutinin__InfluenzaA__ALM06086

SEQ ID NO: 13604 - protein, 566 aa, Artificial Sequence; identical to SEQ ID NO: 10040
  hemagglutinin__InfluenzaA__ALM06087

SEQ ID NO: 13605 - protein, 566 aa, Artificial Sequence
  hemagglutinin__InfluenzaA__ALM06088
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRGQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13606 - protein, 566 aa, Artificial Sequence; identical to SEQ ID NO: 10040
  hemagglutinin__InfluenzaA__ALM06089

SEQ ID NO: 13607 - protein, 566 aa, Artificial Sequence
  hemagglutinin__InfluenzaA__ALN39661
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCIALLGFIMWACQKGNIRCNICI

SEQ ID NO: 13608 - protein, 566 aa, Artificial Sequence; identical to SEQ ID NO: 12974
  hemagglutinin__InfluenzaA__ALN39662

SEQ ID NO: 13609 - protein, 566 aa, Artificial Sequence; identical to SEQ ID NO: 12441
  hemagglutinin__InfluenzaA__ALN39663

SEQ ID NO: 13610 - protein, 566 aa, Artificial Sequence
  hemagglutinin__InfluenzaA__ALN39664
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQPSGRVTVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13611 - protein, 566 aa, Artificial Sequence; identical to SEQ ID NO: 12441
  hemagglutinin__InfluenzaA__ALN39665

SEQ ID NO: 13612 - protein, 566 aa, Artificial Sequence; identical to SEQ ID NO: 13047
  hemagglutinin__InfluenzaA__ALN39666

SEQ ID NO: 13613 - protein, 566 aa, Artificial Sequence
  hemagglutinin__InfluenzaA__ALN39667
MKTIIALSYILCLVFAQKLPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHSNFKYPALNVTMPNNEQFDKLYIWGVHHPGTDKDQIFLYAQSSGRITVSTKRSQQAVTPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRNEALNNRFQIKGVELKSGYKDWILWISFAISCFLLCVALLGFIMWACQKGNIRCNICI

SEQ ID NO: 13614 - protein, 566 aa, Artificial Sequence; identical to SEQ ID NO: 13516
  hemagglutinin__InfluenzaA__ALN39668

SEQ ID NO: 13615 - protein, 566 aa, Artificial Sequence
  hemagglutinin__InfluenzaA__ALN39669
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQLSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13616 - protein, 566 aa, Artificial Sequence; identical to SEQ ID NO: 12441
  hemagglutinin__InfluenzaA__ALN39670

SEQ ID NO: 13617 - protein, 566 aa, Artificial Sequence
  hemagglutinin__InfluenzaA__ALN39671
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13618 - protein, 566 aa, Artificial Sequence; identical to SEQ ID NO: 12441
  hemagglutinin__InfluenzaA__ALN39672

SEQ ID NO: 13619 - protein, 566 aa, Artificial Sequence
  hemagglutinin__InfluenzaA__ALN39673
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPDIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13620 - protein, 566 aa, Artificial Sequence; identical to SEQ ID NO: 12981
  hemagglutinin__InfluenzaA__ALN39674

SEQ ID NO: 13621 - protein, 566 aa, Artificial Sequence; identical to SEQ ID NO: 12441
  hemagglutinin__InfluenzaA__ALN39675

SEQ ID NO: 13622 - protein, 566 aa, Artificial Sequence
  hemagglutinin__InfluenzaA__ALN39676
MKTIIALSCILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNENFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFRIRSGKSSIMRSDAPIGKCKSECITPNGSIPNDKPFQNVNRITYGACPRYVKQNTLKLATGMRNVPERQTRGIFGAIAGFIENGWEGMVDGWYGFRHQNSEGRGQAADLKSTQSAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13623 - protein, 566 aa, Artificial Sequence
  hemagglutinin__InfluenzaA__ALN39677
MKTIIALGYILCLVFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYAYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13624 - protein, 566 aa, Artificial Sequence; identical to SEQ ID NO: 13328
  hemagglutinin__InfluenzaA__ALN39678

SEQ ID NO: 13625 - protein, 566 aa, Artificial Sequence
  hemagglutinin__InfluenzaA__ALN39679
MKTIIALGYILCLVFAQKIPGNDNSTATLCLGHHAVPNGTVVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13626 - protein, 566 aa, Artificial Sequence; identical to SEQ ID NO: 13328
  hemagglutinin__InfluenzaA__ALN39680

SEQ ID NO: 13627 - protein, 566 aa, Artificial Sequence; identical to SEQ ID NO: 13328
  hemagglutinin__InfluenzaA__ALN39681

SEQ ID NO: 13628 - protein, 566 aa, Artificial Sequence; identical to SEQ ID NO: 13328
  hemagglutinin__InfluenzaA__ALN39682

SEQ ID NO: 13629 - protein, 566 aa, Artificial Sequence; identical to SEQ ID NO: 13328
  hemagglutinin__InfluenzaA__ALN39683

SEQ ID NO: 13630 - protein, 566 aa, Artificial Sequence; identical to SEQ ID NO: 13328
  hemagglutinin__InfluenzaA__ALN39684

SEQ ID NO: 13631 - protein, 566 aa, Artificial Sequence; identical to SEQ ID NO: 13328
  hemagglutinin__InfluenzaA__ALN39685

SEQ ID NO: 13632 - protein, 566 aa, Artificial Sequence
  hemagglutinin__InfluenzaA__ALN39686
MKTIIALGYILCLAFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYTSLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13633 - protein, 566 aa, Artificial Sequence; identical to SEQ ID NO: 13328
  hemagglutinin__InfluenzaA__ALN39687

SEQ ID NO: 13634 - protein, 566 aa, Artificial Sequence
  hemagglutinin__InfluenzaA__ALN39688
MKTIIALGYILCLVFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYIYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13635 - protein, 566 aa, Artificial Sequence
  hemagglutinin__InfluenzaA__ALN39689
MKTIIALGYILCLVFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLIHSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13636 - protein, 566 aa, Artificial Sequence
  hemagglutinin__InfluenzaA__ALN39690
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKKWDLFVERSKAHSNCYPYDVPDYASLRSLVASSGTLEFNNESFNWAGVTQNGTSSSCIRGSNSSFFSRLNWLTHLNSIYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13637 - protein, 566 aa, Artificial Sequence
  hemagglutinin__InfluenzaA__ALN39691
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKKWDLFVERSKAHSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQPSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13638 - protein, 566 aa, Artificial Sequence; identical to SEQ ID NO: 13328
  hemagglutinin__InfluenzaA__ALN39692

SEQ ID NO: 13639 - protein, 566 aa, Artificial Sequence; identical to SEQ ID NO: 13328
  hemagglutinin__InfluenzaA__ALN39693

SEQ ID NO: 13640 - protein, 566 aa, Artificial Sequence; identical to SEQ ID NO: 13328
  hemagglutinin__InfluenzaA__ALN39694

SEQ ID NO: 13641 - protein, 566 aa, Artificial Sequence; identical to SEQ ID NO: 13328
  hemagglutinin__InfluenzaA__ALN39695

SEQ ID NO: 13642 - protein, 566 aa, Artificial Sequence; identical to SEQ ID NO: 13328
  hemagglutinin__InfluenzaA__ALN39696

SEQ ID NO: 13643 - protein, 566 aa, Artificial Sequence; identical to SEQ ID NO: 12998
  hemagglutinin__InfluenzaA__ALN39697

SEQ ID NO: 13644 - protein, 566 aa, Artificial Sequence
  hemagglutinin__InfluenzaA__ALN39698
MKTIIALSHILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACMGSIRNGTYDHNVYRNEALNNRFQIKGVELKSGYKDWILWISFAISCFLLCVALLGFIMWACQKGNIRCNICI

SEQ ID NO: 13645 - protein, 566 aa, Artificial Sequence
  hemagglutinin__InfluenzaA__ALN39700
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIKCNICI

SEQ ID NO: 13646 - protein, 566 aa, Artificial Sequence; identical to SEQ ID NO: 13047
  hemagglutinin__InfluenzaA__ALN39701

SEQ ID NO: 13647 - protein, 566 aa, Artificial Sequence
  hemagglutinin__InfluenzaA__ALN39702
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYARSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCSICI

SEQ ID NO: 13648 - protein, 566 aa, Artificial Sequence
  hemagglutinin__InfluenzaA__ALN39703
MKTIIALSYILCLVFAQKIPGNDDSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13649 - protein, 566 aa, Artificial Sequence; identical to SEQ ID NO: 13047
  hemagglutinin__InfluenzaA__ALN39704

SEQ ID NO: 13650 - protein, 566 aa, Artificial Sequence; identical to SEQ ID NO: 12441
  hemagglutinin__InfluenzaA__ALN39705

SEQ ID NO: 13651 - protein, 566 aa, Artificial Sequence
  hemagglutinin__InfluenzaA__ALN39706
MKTIIALSYILCLVFAQKLPGNDNSTATLCLGHHAVPNGMIVKTITNDRIEVTNATELVQNSSIGEICDSPHQILDGKNCTLIDALLGDPQCDDFQNKRWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIQSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13652 - protein, 566 aa, Artificial Sequence; identical to SEQ ID NO: 12441
  hemagglutinin__InfluenzaA__ALN39707

SEQ ID NO: 13653 - protein, 566 aa, Artificial Sequence; identical to SEQ ID NO: 13047
  hemagglutinin__InfluenzaA__ALN39708

SEQ ID NO: 13654 - protein, 566 aa, Artificial Sequence
  hemagglutinin__InfluenzaA__ALN39709
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCMRGSNSSFFSRLNWLTHLNSKYPALNVTMPNNEQFDKLYIWGVHHPGTDKDQIFLYAQSSGRITVSTKRSQQAVTPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13655 - protein, 566 aa, Artificial Sequence; identical to SEQ ID NO: 13371
  hemagglutinin__InfluenzaA__ALN39710

SEQ ID NO: 13656 - protein, 566 aa, Artificial Sequence; identical to SEQ ID NO: 13047
  hemagglutinin__InfluenzaA__ALN39711

SEQ ID NO: 13657 - protein, 566 aa, Artificial Sequence; identical to SEQ ID NO: 12441
  hemagglutinin__InfluenzaA__ALN39712

SEQ ID NO: 13658 - protein, 566 aa, Artificial Sequence
  hemagglutinin__InfluenzaA__ALN39713
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13659 - protein, 566 aa, Artificial Sequence
  hemagglutinin__InfluenzaA__ALN39714
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQTFLYAQPSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13660 - protein, 566 aa, Artificial Sequence; identical to SEQ ID NO: 13099
  hemagglutinin__InfluenzaA__ALN39715

SEQ ID NO: 13661 - protein, 566 aa, Artificial Sequence; identical to SEQ ID NO: 12441
  hemagglutinin__InfluenzaA__ALN39716

SEQ ID NO: 13662 - protein, 566 aa, Artificial Sequence; identical to SEQ ID NO: 12441
  hemagglutinin__InfluenzaA__ALN39717

SEQ ID NO: 13663 - protein, 566 aa, Artificial Sequence; identical to SEQ ID NO: 13479
  hemagglutinin__InfluenzaA__ALN39718

SEQ ID NO: 13664 - protein, 566 aa, Artificial Sequence; identical to SEQ ID NO: 12441
  hemagglutinin__InfluenzaA__ALN39734

SEQ ID NO: 13665 - protein, 566 aa, Artificial Sequence
  hemagglutinin__InfluenzaA__ALN39735
MKTIIALSYILCLVFAQKIPGNDNSTATLCLGHHAVPNGTIVKTITDDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13666 - protein, 566 aa, Artificial Sequence
  hemagglutinin__InfluenzaA__ALN39736
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQPSGRITVSTKRSQQAVIPNIGSRPRIRDIPSRISIYWTIVKPGDILLINSTGNLIAPRGYFKIRGGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQNLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13667 - protein, 566 aa, Artificial Sequence; identical to SEQ ID NO: 13047
  hemagglutinin__InfluenzaA__ALN39737

SEQ ID NO: 13668 - protein, 566 aa, Artificial Sequence
  hemagglutinin__InfluenzaA__ALN39738
MKTIIALSYILCLVFAQKIPGNDNSTATLCLGHHAVPNGTIVKTITNDRIEVTNATELVQNSSIGEICDSPHQILDGENCTLIDALLGDPLCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13669 - protein, 566 aa, Artificial Sequence
  hemagglutinin__InfluenzaA__ALN39739
MKTIIALGYILCLVFAQKIPGNDNSTATLCLGHHAVPNGTIVKTITNDRIEVTNATELVQNSSIGEICDSPHKILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLDYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13670 - protein, 566 aa, Artificial Sequence
  hemagglutinin__InfluenzaA__ALN39740
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTVPNNEQFDKLYIWGVHHPGTDKDQIFLYARSSGRITVSTKRSQQAVIPNIGYRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13671 - protein, 566 aa, Artificial Sequence; identical to SEQ ID NO: 12441
  hemagglutinin__InfluenzaA__ALN39741

SEQ ID NO: 13672 - protein, 566 aa, Artificial Sequence
  hemagglutinin__InfluenzaA__ALN39742
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGDCPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13673 - protein, 566 aa, Artificial Sequence
  hemagglutinin__InfluenzaA__ALN39743
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYIYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13674 - protein, 566 aa, Artificial Sequence
  hemagglutinin__InfluenzaA__ALN39744
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13675 - protein, 566 aa, Artificial Sequence
  hemagglutinin__InfluenzaA__ALN39745
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRKSSSSFFSRLNWLTHLNYKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13676 - protein, 566 aa, Artificial Sequence; identical to SEQ ID NO: 13674
  hemagglutinin__InfluenzaA__ALN39746

SEQ ID NO: 13677 - protein, 566 aa, Artificial Sequence; identical to SEQ ID NO: 13369
  hemagglutinin__InfluenzaA__ALN39747

SEQ ID NO: 13678 - protein, 566 aa, Artificial Sequence
  hemagglutinin__InfluenzaA__ALN39748
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYAYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKILSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13679 - protein, 566 aa, Artificial Sequence
  hemagglutinin__InfluenzaA__ALN39749
MKTIIALSYILCLVFAQKLPGNDNSTATLCLGHHAVPNGTIVKTITNDRIEVTNATELVQNSSIGEICNSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQPSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13680 - protein, 566 aa, Artificial Sequence; identical to SEQ ID NO: 12441
  hemagglutinin__InfluenzaA__ALN39750

SEQ ID NO: 13681 - protein, 566 aa, Artificial Sequence; identical to SEQ ID NO: 12441
  hemagglutinin__InfluenzaA__ALN39789

SEQ ID NO: 13682 - protein, 566 aa, Artificial Sequence; identical to SEQ ID NO: 12971
  hemagglutinin__InfluenzaA__ALO75895

SEQ ID NO: 13683 - protein, 566 aa, Artificial Sequence
  hemagglutinin__InfluenzaA__ALO75907
MEKIVLLLAIVSLVKGDQICIGYHANNSTEQVDTIMEKNVTVTHAQDILEKTHNGKLCDLNGVKPLILKDCSVAGWFLGNRMCDEFIRVPEWSYIVERANPANDLCYPGNLNDYEELKHLLSRINHFEKTLIIPKSSWPNHTSSGVSAACPYQGMPSFFRNVVWLTKKNDAYPTIKMSYNNTYREDLLILWGIHHSNNAAEQTNLYKNPTTYVSVGTSTLNQRLEPKIATRSQVNGQRGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLRERRRKRGLFGAIAGFIEGGWQGMVDGWYGYHHSNEQGSGYAADRESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPLYSEEARLKREEISGVKLESIGTYQILSNYSTVASSLALAIIVAGLSLWMCSNGSLQCRICI

SEQ ID NO: 13684 - protein, 566 aa, Artificial Sequence
  hemagglutinin__InfluenzaA__ALO75919
MEKIVLLLAIVSLVKGDQICIGYHANNSTEQVDTIMEKNVTVTHAQDILEKTHNGKLCDLNGVKPLILKDCSVAGWLHGNRMCDEFIRVPEWSYIVERANPANDLCYPGNLNDYEELKHLLSRINHFEKTLIIPKSSWPNHTSSGVSAACPYQGMPSFFRNVVWLTKKNDAYPTIKMSYNNTYREDLLILWGIHHSNNAAEQTNLYKNPTTYVSVGTSTLNQRLEPKIATRSQVNGQRGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLRERRRKRGLFGAIAGFIEGGWQGMVDGWYGYHHSNEQGSGYAADRESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPLYSEEASLKREEISGVKLESIGTYQILSIYSTVASSLALAIIVAGLSLWMCSNGSLQCRICI

SEQ ID NO: 13685 - protein, 560 aa, Artificial Sequence
  hemagglutinin__InfluenzaA__ALT20080
METVSLITILLVATVSNADKICIGYQSTNSTETVDTLTENNVPVTHAKELLHTEHNGMLCATSLGQPLILDTCTIEGLIYGNPSCDLSLEGREWSYIVERPSAVNGLCYPGNVENLEELRSLFSSARSYQRIQIFPDTIWNVSYDGTSTACSGSFYRSMRWLTRKNGDYPIQDAQYTNNQGKNILFMWGINHPPTDTTQRDLYTRTDTTTSVATEEINRIFKPLIGPRPLVNGLMGRIDYYWSVLKPGQTLRIKSDGNLIAPWFGHILSGESHGRILKTNLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYQEESKLERQKIEGVKLESEGTYKILTIYSTVASSLVIAMGFAAFLFWAMSNGSCRCNICI

SEQ ID NO: 13686 - protein, 566 aa, Artificial Sequence
  hemagglutinin__InfluenzaA__ALT66860
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13687 - protein, 566 aa, Artificial Sequence
  hemagglutinin__InfluenzaA__AMA65391
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRGQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVFLGAISFWMCSNGSLQCRICI

SEQ ID NO: 13688 - protein, 566 aa, Artificial Sequence
  hemagglutinin__InfluenzaA__AMA65393
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSPVASSLVLVVFLGAISFWMCSNGSLQCRICI

SEQ ID NO: 13689 - protein, 566 aa, Artificial Sequence
  hemagglutinin__InfluenzaA__BAA02768
MKAKLLVLLCAFTATDADTICIGYHANNSTDTVDTVLEKNVTVTHSVNLLEDSHNGKLCRLKGIAPLQLGNCSIAGWILGNPECESLFSKESWSYIAETPNSENGTCYPGYFADYEELREQLSSVSSFERFEIFPKESSWPNHTVTKGVTASCSHNGKSSFYRNLLWLTGKNGLYPNLSKSYVNNKEKEVLVLWGVHHPSNIGDQRAIYHTENAYVSVVSSHYSRRFTPEIAKRPKVRGQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMEYLNKKVDDGFLDIWTYNAELLVLLENERTLDFHDSNVKNLYEKVKSQLKNNAKEIGYGCFEFYHKCNNECMESVKNGTYDYPKYSEESKLNREKIDGVKLESMGVYQILAIYSTVASSLVLLVSLGAISFWMCSNGSLQCRICI

SEQ ID NO: 13690 - protein, 566 aa, Artificial Sequence
  hemagglutinin__InfluenzaA__BAA02769
MKAKLLVLLCAFTATDADTICIGYHANNSTDTVDTVLEKNVTVTHSVNLLEDSHNGKLCRLKGIAPLQLGNCSIAGWILGNPECESLFSKESWSYIAETPNSENGTCYPGYFADYEELREQLSSVSSFERFEIFPKESSWPNHTVTKGVTASCSHNGKSSFYRNLLWLTGKNGLYPNLSKSYVNNKEKEVLVLWGVHHPSNIRDQRAIYHTENAYVSVVSSHYSRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVKGLRNIPSIQSRGLFGAIAGFIEGGWTGMIDGWYGYHHQNEQGSGYAADQKSTQNAINGITNKVNSVIEKMNTQFTAVGKEFNKLERRMEYLNKKVDDGFLDIWTYNAELLVLLENERTLDFHDSNVKNLYEKVKSQLKNNAKEIGYGCFEFYHKCNNECMESVKNGTYDYPKYSEESKLNREKIDGVKLESMGVYQILAIYSTVASSLVLLVSLGAISFWMCSNGSLQCRICI

SEQ ID NO: 13691 - protein, 562 aa, Artificial Sequence
  hemagglutinin__InfluenzaA__BAC43764
MAIIYLILLFTAVRGDQICIGYHANNSTEKVDTILERNVTVTHAKNILEKTHNGKLCKLNGIPPLELGDCSIAGWLLGNPECDRLLIVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPIDETEQITLYQNVGTYVSVGTSTLNKRSTPEIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQFRICI

SEQ ID NO: 13692 - protein, 568 aa, Artificial Sequence
  hemagglutinin__InfluenzaA__BAE07201
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGDFNDYEELKHLLSRINHFEKIQIIPKNSWSSHEASLGVSSACPYQGKSSFFRNVVWLIKKNNAYPTIKRSYNNTNQEDLLVLWGIHHPNDAAEQTRLYQNPTTYISVGTSTLNQRLVPKIATRSKVNGQNGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 13693 - protein, 566 aa, Artificial Sequence
  hemagglutinin__InfluenzaA__BAH95823
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKHVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13694 - protein, 566 aa, Artificial Sequence; identical to SEQ ID NO: 2656
  hemagglutinin__InfluenzaA__BAH95824

SEQ ID NO: 13695 - protein, 568 aa, Artificial Sequence
  hemagglutinin__InfluenzaA__BAJ07997
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGDFNDYEELKHLLSRINHFEKIQIIPKNSWSSHEASLGVSSACPYQGKSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 13696 - protein, 566 aa, Artificial Sequence
  hemagglutinin__InfluenzaA__BAJ39949
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAKLLVLLKNERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13697 - protein, 566 aa, Artificial Sequence
  hemagglutinin__InfluenzaA__BAJ39950
MKAILVVLLYTFATANADTLCIGYHANNSTDTVDTVLEKNVTVTHSVNLLEDKHNGKLCKLRGVAPLHLGKCNIAGWILGNPECESLSTASSWSYIAETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13698 - protein, 566 aa, Artificial Sequence
  hemagglutinin__InfluenzaA__BAJ39951
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSFQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13699 - protein, 566 aa, Artificial Sequence; identical to SEQ ID NO: 9272
  hemagglutinin__InfluenzaA__BAJ39952

SEQ ID NO: 13700 - protein, 566 aa, Artificial Sequence
  hemagglutinin__InfluenzaA__BAJ39953
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAKLLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13701 - protein, 566 aa, Artificial Sequence; identical to SEQ ID NO: 9272
  hemagglutinin__InfluenzaA__BAJ39954

SEQ ID NO: 13702 - protein, 566 aa, Artificial Sequence
  hemagglutinin__InfluenzaA__BAJ39955
MKAILVVLLYTFATANADTLSIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSISADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCKICI

SEQ ID NO: 13703 - protein, 566 aa, Artificial Sequence; identical to SEQ ID NO: 13697
  hemagglutinin__InfluenzaA__BAJ39956

SEQ ID NO: 13704 - protein, 566 aa, Artificial Sequence; identical to SEQ ID NO: 9272
  hemagglutinin__InfluenzaA__BAJ39957

SEQ ID NO: 13705 - protein, 566 aa, Artificial Sequence
  hemagglutinin__InfluenzaA__BAJ39958
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSKEAKLNREKIDGVKLESTRIYQILAIYSTVASSLVLVVSLGAISFWMCSNGSLQCRICI

SEQ ID NO: 13706 - protein, 566 aa, Artificial Sequence
  hemagglutinin__InfluenzaA__BAJ39959
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPFIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSKEAKLNREEIDGVKLESTRIYQILAIYSTVASSLVLVVSLGAISFWMCSNGSLQCRICI

SEQ ID NO: 13707 - protein, 566 aa, Artificial Sequence; identical to SEQ ID NO: 2669
  hemagglutinin__InfluenzaA__BAJ39960

SEQ ID NO: 13708 - protein, 566 aa, Artificial Sequence; identical to SEQ ID NO: 3298
  hemagglutinin__InfluenzaA__BAJ39961

SEQ ID NO: 13709 - protein, 566 aa, Artificial Sequence
  hemagglutinin__InfluenzaA__BAJ39962
MKAILVVLLYTFATANADTLCIGYHANNSTDTVDTVLEKNVTVTHSVNLLEDKHNGKLCKLRGVAPLHLGKCNIAGWILGNPECESLSTASSWSYIAETSSSDNGTCYPGDFIDYEELREQLSSVSSFERFEIFPKTSSWPNHDSNKGVTAACPHAGAKSFYKNLTWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPFIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSKEAKLNREEIDGVKLESTRIYQILAIYSTVASSLVLVVSLGAISFWMCSNGSLQCRICI

SEQ ID NO: 13710 - protein, 566 aa, Artificial Sequence; identical to SEQ ID NO: 2669
  hemagglutinin__InfluenzaA__BAJ39963

SEQ ID NO: 13711 - protein, 566 aa, Artificial Sequence; identical to SEQ ID NO: 9272
  hemagglutinin__InfluenzaA__BAJ39964

SEQ ID NO: 13712 - protein, 566 aa, Artificial Sequence; identical to SEQ ID NO: 2669
  hemagglutinin__InfluenzaA__BAJ39965

SEQ ID NO: 13713 - protein, 566 aa, Artificial Sequence; identical to SEQ ID NO: 2669
  hemagglutinin__InfluenzaA__BAJ39966

SEQ ID NO: 13714 - protein, 566 aa, Artificial Sequence
  hemagglutinin__InfluenzaA__BAJ39967
MKAILVVLLYTFATANADTLCIGYHANNSTDTVDTVLEKNVTVTHSVNLLEDKHNGKLCKLRGVAPLHLGKCNIAGWILGNPECELLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTALGKEFNHLEKKIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13715 - protein, 566 aa, Artificial Sequence; identical to SEQ ID NO: 8197
  hemagglutinin__InfluenzaA__BAJ39968

SEQ ID NO: 13716 - protein, 566 aa, Artificial Sequence; identical to SEQ ID NO: 9272
  hemagglutinin__InfluenzaA__BAJ39969

SEQ ID NO: 13717 - protein, 566 aa, Artificial Sequence; identical to SEQ ID NO: 2669
  hemagglutinin__InfluenzaA__BAJ39970

SEQ ID NO: 13718 - protein, 566 aa, Artificial Sequence; identical to SEQ ID NO: 2669
  hemagglutinin__InfluenzaA__BAJ39971

SEQ ID NO: 13719 - protein, 566 aa, Artificial Sequence; identical to SEQ ID NO: 3298
  hemagglutinin__InfluenzaA__BAJ39972

SEQ ID NO: 13720 - protein, 566 aa, Artificial Sequence
  hemagglutinin__InfluenzaA__BAJ39973
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13721 - protein, 566 aa, Artificial Sequence; identical to SEQ ID NO: 2669
  hemagglutinin__InfluenzaA__BAJ39974

SEQ ID NO: 13722 - protein, 566 aa, Artificial Sequence; identical to SEQ ID NO: 3238
  hemagglutinin__InfluenzaA__BAJ39975

SEQ ID NO: 13723 - protein, 566 aa, Artificial Sequence
  hemagglutinin__InfluenzaA__BAJ39976
MKAILVVLLYTFATANADTLCIGYHANNSTDTVDTVLEKNVTVTHSVNLLEDKHNEKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAINFWMCSNGSLQCRICI

SEQ ID NO: 13724 - protein, 566 aa, Artificial Sequence; identical to SEQ ID NO: 2669
  hemagglutinin__InfluenzaA__BAJ39977

SEQ ID NO: 13725 - protein, 566 aa, Artificial Sequence
  hemagglutinin__InfluenzaA__BAJ39978
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13726 - protein, 566 aa, Artificial Sequence
  hemagglutinin__InfluenzaA__BAJ39979
MKAILVVLLYTFATANADTLCIGYHANNSTDTVDTVLEKNVTVTHSVNLLEDKHNGKLCKLRGVAPLHLGKCNIAGWILGNPECELLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMDYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLENRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13727 - protein, 566 aa, Artificial Sequence; identical to SEQ ID NO: 9272
  hemagglutinin__InfluenzaA__BAJ39980

SEQ ID NO: 13728 - protein, 566 aa, Artificial Sequence
  hemagglutinin__InfluenzaA__BAJ39981
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCSKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSKEAKLNREKIDGVKLESTRIYQILAIYSTVASSLVLVVSLGAISFWMCSNGSLQCRICI

SEQ ID NO: 13729 - protein, 566 aa, Artificial Sequence
  hemagglutinin__InfluenzaA__BAJ39982
MKAILVVLLYTFATANAATLCIGYHANNSTDTVDTLLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13730 - protein, 566 aa, Artificial Sequence; identical to SEQ ID NO: 13697
  hemagglutinin__InfluenzaA__BAJ39983

SEQ ID NO: 13731 - protein, 566 aa, Artificial Sequence
  hemagglutinin__InfluenzaA__BAJ39984
MKAILVVLLYTFATANADTLCIGYHANNSTDTVDTVLEKNVTVTHSVNLLEDKHNGKLCKLRGVAPLHLGKCNIAGWILGNPECELLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13732 - protein, 566 aa, Artificial Sequence; identical to SEQ ID NO: 2669
  hemagglutinin__InfluenzaA__BAJ39985

SEQ ID NO: 13733 - protein, 566 aa, Artificial Sequence
  hemagglutinin__InfluenzaA__BAJ39987
MKTILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSKEAKLNREEIDGVKLESTRIYQILAIYSTVASSLVLVVSLGAISFWMCSNGSLQCRICI

SEQ ID NO: 13734 - protein, 566 aa, Artificial Sequence
  hemagglutinin__InfluenzaA__BAJ39988
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSIYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCSKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13735 - protein, 566 aa, Artificial Sequence; identical to SEQ ID NO: 3983
  hemagglutinin__InfluenzaA__BAJ39989

SEQ ID NO: 13736 - protein, 566 aa, Artificial Sequence; identical to SEQ ID NO: 2669
  hemagglutinin__InfluenzaA__BAJ39990

SEQ ID NO: 13737 - protein, 566 aa, Artificial Sequence; identical to SEQ ID NO: 2669
  hemagglutinin__InfluenzaA__BAJ39993

SEQ ID NO: 13738 - protein, 566 aa, Artificial Sequence
  hemagglutinin__InfluenzaA__BAJ39994
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPTTIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCLESVKNGTYDYPKYSEEAKLNREKIDGVKLESTRIYQILAIYSTVASSLVLVVSLGAISFWMCSNGSLQCRICI

SEQ ID NO: 13739 - protein, 566 aa, Artificial Sequence; identical to SEQ ID NO: 2669
  hemagglutinin__InfluenzaA__BAJ39996

SEQ ID NO: 13740 - protein, 566 aa, Artificial Sequence
  hemagglutinin__InfluenzaA__BAJ39997
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPTTIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13741 - protein, 566 aa, Artificial Sequence; identical to SEQ ID NO: 2669
  hemagglutinin__InfluenzaA__BAJ39998

SEQ ID NO: 13742 - protein, 566 aa, Artificial Sequence
  hemagglutinin__InfluenzaA__BAJ39999
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13743 - protein, 566 aa, Artificial Sequence
  hemagglutinin__InfluenzaA__BAJ40000
MKTILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13744 - protein, 566 aa, Artificial Sequence; identical to SEQ ID NO: 7679
  hemagglutinin__InfluenzaA__BAJ40001

SEQ ID NO: 13745 - protein, 566 aa, Artificial Sequence; identical to SEQ ID NO: 2669
  hemagglutinin__InfluenzaA__BAJ40002

SEQ ID NO: 13746 - protein, 566 aa, Artificial Sequence; identical to SEQ ID NO: 7679
  hemagglutinin__InfluenzaA__BAJ40003

SEQ ID NO: 13747 - protein, 566 aa, Artificial Sequence
  hemagglutinin__InfluenzaA__BAJ40004
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGETAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13748 - protein, 566 aa, Artificial Sequence
  hemagglutinin__InfluenzaA__BAJ40006
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGREVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13749 - protein, 566 aa, Artificial Sequence; identical to SEQ ID NO: 2669
  hemagglutinin__InfluenzaA__BAJ40007

SEQ ID NO: 13750 - protein, 566 aa, Artificial Sequence
  hemagglutinin__InfluenzaA__BAJ40008
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYIAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13751 - protein, 566 aa, Artificial Sequence
  hemagglutinin__InfluenzaA__BAJ40009
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMDYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLENRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13752 - protein, 566 aa, Artificial Sequence
  hemagglutinin__InfluenzaA__BAJ40010
MKAILVVLLYTFATANADTLCIGYHANNSTDTVDTVLEKNVTVTHSVNLLEDKHNGKLCKLRGVAPLHLGKCNIAGWILGNPECELLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMDYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13753 - protein, 566 aa, Artificial Sequence; identical to SEQ ID NO: 13742
  hemagglutinin__InfluenzaA__BAJ40011

SEQ ID NO: 13754 - protein, 566 aa, Artificial Sequence
  hemagglutinin__InfluenzaA__BAJ40012
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGIKLESTRIYQILAIYSTVASSLVLVVSLGAISFWMCSNGSLQCRICI

SEQ ID NO: 13755 - protein, 566 aa, Artificial Sequence; identical to SEQ ID NO: 13742
  hemagglutinin__InfluenzaA__BAJ40013

SEQ ID NO: 13756 - protein, 566 aa, Artificial Sequence; identical to SEQ ID NO: 13742
  hemagglutinin__InfluenzaA__BAJ40014

SEQ ID NO: 13757 - protein, 566 aa, Artificial Sequence
  hemagglutinin__InfluenzaA__BAJ40015
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPNTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13758 - protein, 566 aa, Artificial Sequence; identical to SEQ ID NO: 13742
  hemagglutinin__InfluenzaA__BAJ40016

SEQ ID NO: 13759 - protein, 566 aa, Artificial Sequence
  hemagglutinin__InfluenzaA__BAJ40017
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQKAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13760 - protein, 566 aa, Artificial Sequence; identical to SEQ ID NO: 3833
  hemagglutinin__InfluenzaA__BAJ40018

SEQ ID NO: 13761 - protein, 566 aa, Artificial Sequence; identical to SEQ ID NO: 13748
  hemagglutinin__InfluenzaA__BAJ40019

SEQ ID NO: 13762 - protein, 566 aa, Artificial Sequence; identical to SEQ ID NO: 13748
  hemagglutinin__InfluenzaA__BAJ40020

SEQ ID NO: 13763 - protein, 566 aa, Artificial Sequence
  hemagglutinin__InfluenzaA__BAJ40021
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGETAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13764 - protein, 566 aa, Artificial Sequence; identical to SEQ ID NO: 3833
  hemagglutinin__InfluenzaA__BAJ40023

SEQ ID NO: 13765 - protein, 566 aa, Artificial Sequence
  hemagglutinin__InfluenzaA__BAJ40024
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13766 - protein, 566 aa, Artificial Sequence; identical to SEQ ID NO: 13742
  hemagglutinin__InfluenzaA__BAJ40025

SEQ ID NO: 13767 - protein, 566 aa, Artificial Sequence; identical to SEQ ID NO: 3833
  hemagglutinin__InfluenzaA__BAJ40026

SEQ ID NO: 13768 - protein, 566 aa, Artificial Sequence
  hemagglutinin__InfluenzaA__BAJ40027
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGETAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13769 - protein, 566 aa, Artificial Sequence
  hemagglutinin__InfluenzaA__BAJ40028
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAAFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13770 - protein, 566 aa, Artificial Sequence; identical to SEQ ID NO: 13742
  hemagglutinin__InfluenzaA__BAJ40029

SEQ ID NO: 13771 - protein, 566 aa, Artificial Sequence
  hemagglutinin__InfluenzaA__BAJ40030
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELKEQLSSVSSFERFEIFPKTSSWPNHDSNKGVTAACPHAGAKSFYKNLIWLVKKGNSYPKLSKSYINDKGREVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13772 - protein, 566 aa, Artificial Sequence; identical to SEQ ID NO: 2669
  hemagglutinin__InfluenzaA__BAJ40031

SEQ ID NO: 13773 - protein, 566 aa, Artificial Sequence; identical to SEQ ID NO: 13742
  hemagglutinin__InfluenzaA__BAJ40032

SEQ ID NO: 13774 - protein, 566 aa, Artificial Sequence; identical to SEQ ID NO: 13771
  hemagglutinin__InfluenzaA__BAJ40033

SEQ ID NO: 13775 - protein, 566 aa, Artificial Sequence
  hemagglutinin__InfluenzaA__BAJ40034
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13776 - protein, 566 aa, Artificial Sequence
  hemagglutinin__InfluenzaA__BAJ40035
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKIKFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13777 - protein, 566 aa, Artificial Sequence
  hemagglutinin__InfluenzaA__BAJ40036
MKAILVVLIYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTIVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13778 - protein, 566 aa, Artificial Sequence; identical to SEQ ID NO: 9272
  hemagglutinin__InfluenzaA__BAJ40037

SEQ ID NO: 13779 - protein, 566 aa, Artificial Sequence
  hemagglutinin__InfluenzaA__BAJ40038
MKAILLVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTIVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13780 - protein, 566 aa, Artificial Sequence; identical to SEQ ID NO: 2669
  hemagglutinin__InfluenzaA__BAJ40039

SEQ ID NO: 13781 - protein, 566 aa, Artificial Sequence
  hemagglutinin__InfluenzaA__BAJ40040
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGREVLVLWGIHHPSTSADQQSLYQNADTYVFVGTSRYSKKFKPEIAIRPKVRDQEGRMNYYWTLVEPGDKITFEATGNLVVPRYAFAMERNAGYGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13782 - protein, 566 aa, Artificial Sequence; identical to SEQ ID NO: 9272
  hemagglutinin__InfluenzaA__BAJ40041

SEQ ID NO: 13783 - protein, 566 aa, Artificial Sequence
  hemagglutinin__InfluenzaA__BAJ40042
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELKEPLSSVSSFERFEIFPKTSSWPNHDSNKGVTAACPHAGAKSFYKNLIWLVKKGNSYPKLSKSYINDKGREVLVLWGIHHPSTSADRQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13784 - protein, 566 aa, Artificial Sequence; identical to SEQ ID NO: 9272
  hemagglutinin__InfluenzaA__BAJ40043

SEQ ID NO: 13785 - protein, 566 aa, Artificial Sequence
  hemagglutinin__InfluenzaA__BAJ40044
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEEQKEQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMEINAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13786 - protein, 566 aa, Artificial Sequence; identical to SEQ ID NO: 13748
  hemagglutinin__InfluenzaA__BAJ40045

SEQ ID NO: 13787 - protein, 566 aa, Artificial Sequence
  hemagglutinin__InfluenzaA__BAJ40046
MKAILVVLLYTFATANADTLCIGYHANNSTDTVDTVLEKNVTVTHSVNLLEDKHNGKLCKLRGVAPLHLGRCNIAGWILGNPECESLSTASSWSYIVETSISDNGTCYPGDFIDYEELKEQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKKIENLNKKVDDGFLDIWTYNAKLLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13788 - protein, 566 aa, Artificial Sequence; identical to SEQ ID NO: 13771
  hemagglutinin__InfluenzaA__BAJ40047

SEQ ID NO: 13789 - protein, 566 aa, Artificial Sequence; identical to SEQ ID NO: 13742
  hemagglutinin__InfluenzaA__BAJ40048

SEQ ID NO: 13790 - protein, 566 aa, Artificial Sequence
  hemagglutinin__InfluenzaA__BAJ40050
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELKEQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13791 - protein, 566 aa, Artificial Sequence; identical to SEQ ID NO: 3833
  hemagglutinin__InfluenzaA__BAJ40051

SEQ ID NO: 13792 - protein, 566 aa, Artificial Sequence
  hemagglutinin__InfluenzaA__BAJ40052
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGREVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13793 - protein, 566 aa, Artificial Sequence
  hemagglutinin__InfluenzaA__BAJ40053
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13794 - protein, 566 aa, Artificial Sequence; identical to SEQ ID NO: 3833
  hemagglutinin__InfluenzaA__BAJ40054

SEQ ID NO: 13795 - protein, 566 aa, Artificial Sequence
  hemagglutinin__InfluenzaA__BAJ40055
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADTYVFVGTSRYSKKFKPEIAIRPKVRDQEGRMNYYWTLVEPGDKITFEATGNLVVPRYAFAMERNAGSGIIISDTPVHDCNTICQTPKGAINTSLPFQNIHPITIGKCPKYVKSTKLRLATGLRNVPSVQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13796 - protein, 566 aa, Artificial Sequence
  hemagglutinin__InfluenzaA__BAJ40056
MKAILVVLLYTFATANADTLCIGYHANNSTDTVDTVLEKNVTVTHSVNLLEDKHNGKLCKLRGVAPLHLGKCNIAGWILGNPECELLSTASSWSYIVETSSSDNGTCYPGDFIDYEELREQLSSVSSFERFEIFPKTSSWPNHDSNKGVTAACPHAGAKSFYKNLIWQVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRHAFAMERNAGSGIIISDTPVHNCNTTCQTPKGAINTSLPFQNIHPITIGKCPKYVKSPKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSYVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13797 - protein, 566 aa, Artificial Sequence
  hemagglutinin__InfluenzaA__BAJ40057
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNEVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13798 - protein, 566 aa, Artificial Sequence; identical to SEQ ID NO: 9272
  hemagglutinin__InfluenzaA__BAJ40058

SEQ ID NO: 13799 - protein, 566 aa, Artificial Sequence; identical to SEQ ID NO: 13742
  hemagglutinin__InfluenzaA__BAJ40059

SEQ ID NO: 13800 - protein, 566 aa, Artificial Sequence; identical to SEQ ID NO: 3833
  hemagglutinin__InfluenzaA__BAJ40060

SEQ ID NO: 13801 - protein, 566 aa, Artificial Sequence
  hemagglutinin__InfluenzaA__BAJ40061
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKASSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13802 - protein, 566 aa, Artificial Sequence
  hemagglutinin__InfluenzaA__BAJ40062
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKKIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCKICI

SEQ ID NO: 13803 - protein, 566 aa, Artificial Sequence; identical to SEQ ID NO: 13801
  hemagglutinin__InfluenzaA__BAJ40063

SEQ ID NO: 13804 - protein, 566 aa, Artificial Sequence; identical to SEQ ID NO: 9272
  hemagglutinin__InfluenzaA__BAJ40064

SEQ ID NO: 13805 - protein, 568 aa, Artificial Sequence
  hemagglutinin__InfluenzaA__BAK23398
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPVNDLCYPGNFNDYEELKHLLSRINHFEKIQIFPKSSWSDHEASSGVSSACPYQGRSSFFRNVVWLVKKDNAYPTIKKSYNNTNQEDLLILWGIHHPNDAAEQTRLYQNPTTYISVGTSTLNQRLVPKIATRSKVNGQSGRIEFFWTILKSNDVINFESNGNFIAPENAYKIVKKGDSTIMKSELEYGNCNTKCQTPIGAINSSMPFHNIHPLTIGECPKYVKSNRLVLATGLRNSPRGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVKNGTYDYPQYSEEARLKREEISGVKLESIGTYQILSIYSTVASSLALAIMMAGLFLWMCSNGSLQCRICI

SEQ ID NO: 13806 - protein, 568 aa, Artificial Sequence
  hemagglutinin__InfluenzaA__BAK23400
MEKIVLLLAIVSLVKSDQICIGYHANNSTEQVDTIMEKNVTVTHAQDILEKTHNGKLCDLNGVKPLILRDCSVAGWLLGNPMCDEFLNVPEWSYIVEKINPANDLCYPGDFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYHNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSSRLVLATGLRNSPQGKSRRKKRGLFGAIAGFIEGGWQGMVDGWYGYHHSNEQGSGYAADKESTQRAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGIYQILSIYSTVASSLALAIMVAGLFLWMCSNGSLQCRICI

SEQ ID NO: 13807 - protein, 568 aa, Artificial Sequence
  hemagglutinin__InfluenzaA__BAK23401
MEKIVLLLAIVSLVKSDQICIGYHANNSTEQVDTIMEKNVTVTHAQDILEKTHNGKLCDLDGVKPLILRDCSVAGWLLGNPMCDEFLNVSEWSYIVEKINPANDLCYPGNFNNYEELKHLLSRINRFEKIQIIPKSSWPDHEASLGVSSACPYQGGPSFYRNVVWLIKKNNTYPIIKKSYHNTNQEDLLVLWGIHHPNDEEEQTRIYKNPTTYISVGTSTLNQRLVPKIATRSKVNGQSGRVEFFWTILKSNDTINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNIQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 13808 - protein, 568 aa, Artificial Sequence
  hemagglutinin__InfluenzaA__BAK23402
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSNHEASSGVSSACPYQGRSSFFRNVVWLIKKDNAYPTIKISYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNTHPLTIGECPKYVKSNRLVLATGLRNSPHGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 13809 - protein, 568 aa, Artificial Sequence
  hemagglutinin__InfluenzaA__BAK23403
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSNHEASSGVSSACPYQGRSSFFRNVVWLIKKDNAYPTIKISYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 13810 - protein, 568 aa, Artificial Sequence
  hemagglutinin__InfluenzaA__BAK23404
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 13811 - protein, 568 aa, Artificial Sequence; identical to SEQ ID NO: 13810
  hemagglutinin__InfluenzaA__BAK23405

SEQ ID NO: 13812 - protein, 568 aa, Artificial Sequence
  hemagglutinin__InfluenzaA__BAK23406
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPVNDLCYPGNFNDYEELKHLLSRINHFEKIQIFPKSSWSDHEASSGVSSACPYQGRSSFFRNVVWLVKKDNAYPTIKKSYNNTNQEDLLILWGIHHPNDAAEQTRLYQNPTTYISVGTSTLNQRLVPKIATRSKVNGQSGRIEFFWTILKSNDVINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVKNGTYDYPQYSEEARLKREEISGVKLESIGTYQILSIYSTVASSLALAIMMAGLFLWMCSNGSLQCRICI

SEQ ID NO: 13813 - protein, 568 aa, Artificial Sequence
  hemagglutinin__InfluenzaA__BAK23407
MEKIVLLLAIVSLVKSGQICIGYHANNSTEQVDTIMEKNVTVTHAQDILEKTHNGKLCDLDGVKPLILRDCSVAGWLLGNPMCDEFLNVSEWSYIVEKINPANDLCYPGNFNNYEELKHLLSRINRFEKIQIIPKSSWPDHEASLGVSAACPYQGGPSFYRNVVWLIKKNNTYPTIEKSYHNTNQEDLLVLWGIHHPNDEAEQTRIYKNPTTYISVGTSTLNQRLVPKIATRSKVNGQSGRVEFFWTILKSNDTINFESNGNFIAPENAYKIVKKGDSTIMKSELEYGNCNTRCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 13814 - protein, 568 aa, Artificial Sequence
  hemagglutinin__InfluenzaA__BAK23408
MEKIVLLLAIVSLVKSDQICIGYHANNSTEQVDTIMEKNVTVTHAQDILEKTHNGKLCDLDGVKPLILRDCSVAGWLLGNPMCDEFPNVSEWSYIVEKINPANDLCYPGNFNNYEELKHLLSRINRFEKIQIIPKSSWPDHEASLGVSSACQYQGGPSFYRNVVWLIKKDNAYPTIKKSYHNTNKEDLLVLWGIHHPNNEEEQTKLYQNPTTYISVGTSTLNQRLVPKIATRSKVNGQSGRVEFFWTILKSNDAINFESNGNFIAPENAYKIVKKGDSTIMKSELEYGNYNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGKEFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 13815 - protein, 568 aa, Artificial Sequence
  hemagglutinin__InfluenzaA__BAK23411
MEKIVLLLAIVSLVKSDQICIGYHANNSTEQVDTIMEKNVTVTHAQDILEKTHNGKLCDLDGVKPLILRDCSVAGWLLGNPMCDEFLNVSEWSYIVEKINPANDLCYPGNFNNYEELKHLLSRINRFEKIQIIPKSSWPDHEASLGVSSACQYQGGPSFYRNVVWLIKKDNAYPTIKKSYHNTNKEDLLVLWGIHHPNNEEEQTKLYQNPTTYISVGTSTLNQRLVPKIATRSKVNGQSGRVEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGKEFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 13816 - protein, 568 aa, Artificial Sequence
  hemagglutinin__InfluenzaA__BAK23412
MEKIVLLLAIVSLVKSDQICIGYHANNSTEQVDTIMEKNVTVTHAQDILEKTHKGKLCDLDGVKPLILRDCSVAGWLLGNPMCDEFLNVSEWSYIVEKINPANDLCYPGNFNNYEELKHLLSRINRFEKIQIIPKSSWPDHEASLGVSSACQYQGGPSFYRNVVWLIKKDNTYPTIKKSYHNTNKEDLLVLWGIHHPNNEEEQTKLYQNPTTYISVGTSTLNQRLVPKIATRSKVNGQSGRVEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGKEFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESTGTYQILSIYSTVASSLALAIMVAGLFLWMCSNGSLQCRICI

SEQ ID NO: 13817 - protein, 568 aa, Artificial Sequence
  hemagglutinin__InfluenzaA__BAK23413
MEKIVLLLAIVSLVKSDQICIGYHANNSTEQVDTIMEKNVTVTHAQDILEKTHNGKLCDLDGVKPLILRDCSVAGWLLGNPMCDEFLNVSEWSYIVEKINPANDLCYPGNFNNYEELKHLLSRINRFEKIQIIPKSSWPDHEASLGVSSACQYQGGPSFYRNVVWLIKKDNTYPTIKKSYHNTNKEDLLVLWGIHHPNNEEEQTKLYQNPTTYISVGTSTLNQRLVPKIATRSKVNGQSGRVEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGKEFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 13818 - protein, 568 aa, Artificial Sequence; identical to SEQ ID NO: 13815
  hemagglutinin__InfluenzaA__BAK23414

SEQ ID NO: 13819 - protein, 565 aa, Artificial Sequence
  hemagglutinin__InfluenzaA__BAM65746
MEVKLLVLLCTFTATYADTICIGYHANNSTDTVDTLPEKNVTVTHSVNLLEDTHNGKLCLLKGIAPLQLGNCSVAGWILGNPECELLISRESWSYIVEKPNPENGICYPGHFADYEELREQLSSVSSFERFEIFPKESSWPNHTATGVSASCSHNGKSSFYKNLLWLTVKNGLYPNLSKSYANNKEKEVLVLWGVHHPTNIGDQRALYHTENAYVSVVSSHYSRRFTPEIAKRPKVRDQEGRINYYWTLLEPGDTIIFEANGNLIAPRYAFALSRGFGSGIIKSNAPMDECNAKCQTPQGAINSSLPFQNVHPVTIGECPKYVRSTKLRMVTGLRNTPSIQSRGLFGAIAGFIEGGWTGMVDGWYGYHHQNEQGSGYAADQKSTQNAINGITNKVNSVIEKMNTQFTAVDKEFNKLERRMENFNKKVDDGFIDIWTYNAELLILLENERTLDFHDSNVKNLYEKVKSQLKNNAKEIGNGCFEFYHKCNDECMESVKNGTYDYPKYSEESKLNREKIDGVKLESMGVYQILAIYSTVASSMVLLVSLGAISFWMCSNGSLQCRICI

SEQ ID NO: 13820 - protein, 566 aa, Artificial Sequence; identical to SEQ ID NO: 12566
  hemagglutinin__InfluenzaA__BAO79716

SEQ ID NO: 13821 - protein, 560 aa, Artificial Sequence
  Hemagglutinin__InfluenzaA__CAB95856
METISLITILLVVTASNADKICIGHQSTNSTETVDTLTETNVPVTHAKELLHTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVRVNSLKLAVGLRNVPARSSRGLFGAIAGFIEGGWPGLVAGWYGFQHSNDQGVGMAADRDSTQKAIDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYNRRKYREESRLERQKIEGVKLESEGTYKILTIYSTVASSLVLAMGFAAFLFWAMSNGSCRCNICI

SEQ ID NO: 13822 - protein, 560 aa, Artificial Sequence
  Hemagglutinin__InfluenzaA__CAB95857
METISLITILLVVTASNADKICIGHQSTNSTETVDTLTETNVPVTHAKELLHTEHNGMLCATSLGHPLILDTCTIEGLVYGNPSCDLLLEGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKSGNCVVQCQTEKGGLNSTLPFHNISKYAFGTCPKYVRVNSLKLAVGLRNVPARSSRGLFGAIAGFIEGGWPGLVAGWYGFQHSNDQGVGMAADRDSTQKAIDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYNRRKYREESRLERQKIEGVKLESEGAYKILTIYSTVASSLVLAMGFAAFLFWAMSNGSCRCNICI

SEQ ID NO: 13823 - protein, 568 aa, Artificial Sequence
  hemagglutinin__InfluenzaA__CBW54815
MEKIVLLLAIVSLVKSDQICIGYHANNSTEQVDTIMEKNVTVTHAQDILEKTHNGKLCDLDGVKPLILRDCSVAGWLLGNPMCDEFPNVSEWSYIVEKTNPANDLCYPGNFDNYEELKHLLSRINRFEKIQIIPKSSWPDHEASLGVSSACPYQGGPSFYRNVVWLIKKNNTYPTIKESYHNTNQEDLLVLWGIHHPNDEEEQTRIYKNPTTYISVGTSTLNQRLVPKIATRSKVNGQSGRVEFFWTILKSNDTINFESNGNFIAPENAYKIVKKGDSTIMKSELEYGNCSTKCQTPIGAINSSMPFHNIHPLTIGECPKYVKSNRLVLATGLRNSPQGEGRRKKRGLFGAIAGFIEGGWQGMVDGWYGYHHSNEQGSGYAADKESTQKAIDGVTNKVNSIIDKMNTQFEAVGREFNNLEKRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 13824 - protein, 568 aa, Artificial Sequence
  hemagglutinin__InfluenzaA__CBW54817
MEKIVLLLAIVSLVKSDQICIGYHANNSTEQVDTIMEKNVTVTHAQDILEKTHNGKLCDLDGVKPLILRDCSVAGWLLGNPMCDEFPNVSEWSYIVEKINPANDLCYPGNFNNYEELKHLLSRINRFEKIQIIPKSSWPDHEASLGVSSACPYQRGPSFYRNVVWLIKKNDTYPTIKESYHNTNQEDLLVLWGIHHPNDEEEQKRIYKNPTTYISVGTSTLNQRLVPKIATRSKVNGQSGRVEFFWTILKSNDTINFESNGNFIAPENAYKIVKKGDSTIMKSELEYGNCSTKCQTPIGAINTSMPFHNIHPLTIGECPKYVKSNRLVLATGLRNSPQGEGRRKKRGLFGAIAGFIEGGWQGMVDGWYGYHHSNEQGSGYAADKESTQKAIDGVTNKVNSIIDKMNTQFEAVGREFNNLEKRIENLNKKMEDGFLDVWTYNAELLVLMENERTLDFHDSNVRNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 13825 - protein, 568 aa, Artificial Sequence
  hemagglutinin__InfluenzaA__CBW54818
MEKIVLLLAIVSLVKSDQICIGYHANNSTEQVDTIMEKNVTVTHAQDILEKTHNGKLCDLDGVKPLILRDCSVAGWLLGNPMCDEFPNVSEWSYIVEKTNPANDLCYPGNFNNYEELKHLLSRINRFEKIKIIPKSSWPDHEASLGVSSACPYQGGPSFYRNVVWLIKKNNTYPTIKESYHNTNQEDLLVLWGIHHPNDEEEQTRIYKNPTTYISVGTSTLNQRLVPKIATRSKVNGQSGRVEFFWTILKSNDTINFESNGNFIAPENAYKIVKKGDSTIMKSELEYGNCSTKCQTPVGAINSSMPFHNIHPLTIGECPKYVKSNRLVLATGLRNSPQGEGRRKKRGLFGAIAGFIEGGWQGMVDGWYGYHHSNEQGSGYAADRESTQKAIDGVTNKVNSIIDKMNTQFEAVGREFNNLEKRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIIVAGLLLWMCSNGSLQCRICI

SEQ ID NO: 13826 - protein, 566 aa, Artificial Sequence
  hemagglutinin__InfluenzaA__CCG47908
MKTVIALSYVFCLGFGQGLPGKGNNTATLCLGHHAVPNGTLVKTITDDQIEVTNATELVQNFSMGKICKNPHRILDGANCTLIDSLLGDPHCDGFQDEKWDLFIERSKAFSNCYPYDVPEYTSLRSIIASSGTLEFTNEDFNWTGVTQNGGSSACKRGPNNSFFSRLNWLYKSGNTYPMLNVTMPNSDDFDKLYIWGVHHPSTDREQTNLYIQASGKIIVSTKRSQQTIIPNIGSRPWVRGLSSRISIYWTIVKPGDILIINSNGNLIAPRGYFKIQTGKSSVMRSDAPIDTCNSECITPNGSIPNDKPFQNVNRITYGACPKYIKQNTLKLATGMRNIPERQTRGIFGAIAGFIENGWEGMVNGWYGFRHQNSEGIGQAADLKSTQAAINQINGKLNRVIEKTNEKFHQIEKEFSEVEGRIQDLERYVEDTKIDLWSYNAELLVALENQHTIDLTDSEMNKLFEKTRKQLRENAEDMGNGCFKIYHKCDNSCMESIRNGTYDHNEYRDEAVNNRFQIKSVELKSGYKDWILWISFAISCFLLCAVWLGFIIWACQKGNIRCNICI

SEQ ID NO: 13827 - protein, 566 aa, Artificial Sequence
  hemagglutinin_precursor_(high_yield_phenotype)__InfluenzaA_ _AAB39851
MKAILLVLLCTFAATNADTLCIGYHANNSTDTVDTVLEKNVTVTHSVNLLEDRHNGKLCKLGGIAPLHLGKCNIAGRLLGNPECELLLTVSSWSYIVETSKSDNGTCYPGDFINYEELREQLSSVSSFERFEIFPKTSSWPNHETNRGVTAACPYAGANSFYRNLIWLVKKENSYPKLSKSYVNNKGKEVLVLWGIHHPPTSTDQQSLYQNADAYVFVGSSKYNRKFKPEIAARPKVRGQAGRMSYYWTLIEPGDTITFEATGNLVVPRYAFAMNRGSGSGIIIWDAPVHDCNTKCQTPKGAINTSLPFQNIHPVTIGECPKYVKSTKLRMATGLRNVPSIQSRGLFGAIAGFIEGGWTGMIDGWYGYHHQNEQGSGYAADQRSTQNAIDGITNKVNSVIEKMNTQFTAVGKEFNHLEKRIENLNKKVDDGFLDIWTYNAELLVLLENERTLDFHDSNVKNLYEKVRSQLRNNAKEIGNGCFEFYHKCDDTCMESVKNGTYDYPKYSEESKLNREEIDGVKLESTRIYQILAIYSTVASSLVLLVSLGAISFWMCSNGSLQCRICI

SEQ ID NO: 13828 - protein, 566 aa, Artificial Sequence
  hemagglutinin_precursor__InfluenzaA__AAA43178
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 13829 - protein, 562 aa, Artificial Sequence
  hemagglutinin_precursor__InfluenzaA__AAA43185
MAIIYLILLFTAVRGDQICIGYHANNSTEKVDTNLERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKEGSDYPVAKGSYNNTSGEQMLIIWGVHHPIDETEQRTLYQNVGTYVSVGTSTLNKRSTPEIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFGNLERRLENLNKRMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 13830 - protein, 566 aa, Artificial Sequence
  hemagglutinin_precursor__InfluenzaA__AAA43187
MKTIIALSHIFCLVLGQYLPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFITEGFTWTGVTQNGGSNACKRGPGSGFFSRLNWLTKSESTYPVLNVTMPNNDNFDKLYIWGVHHPSTNQEQTSLYVQASGRVTVSTRRSQQTIIPNIGSRPWVRGLSSRISIYWTIVKPGDVLVINSNANLIAPRGYFKMRTGKSSIMRSDAPIDTCISECITPNGSIPNDKPFQNVNKITYGACPKYVKQNTLKLATRMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYDKCDNACIESIRNGTYDHDVYRDEALNNRFQIKGVELKSGYKDWILWISFAISCFLLCVVLLGFIMWACQRGNIRCNICI

SEQ ID NO: 13831 - protein, 565 aa, Artificial Sequence
  hemagglutinin_precursor__InfluenzaA__AAA43209
MKAKLLVLLYAFVATDADTICIGYHANNSTDTVDTIFEKNVAVTHSVNLLEDRHNGKLCKLKGIAPLQLGKCNITGWLLGNPECDSLLPARSWSYIVETPNSENGACYPGDFIDYEELREQLSSVSSLERFEIFPKESSWPNHTFNGVTVSCSHRGKSSFYRNLLWLTKKGDSYPKLTNSYVNNKGKEVLVLWGVHHPSSSDEQQSLYSNGNAYVSVASSNYNRRFTPEIAARPKVKDQHGRMNYYWTLLEPGDTIIFEATGNLIAPWYAFALSRGFESGIITSNASMHECNTKCQTPQGSINSNLPFQNIHPVTIGECPKYVRSTKLRMVTGLRNIPSIQYRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDLNVKNLYEKVKSQLKNNAKEIGNGCFEFYHKCDNECMESVRNGTYDYPKYSEESKLNREKIDGVKLESMGVYQILAIYSTVASSLVLLVSLGAISFWMCSNGSLQCRICI

SEQ ID NO: 13832 - protein, 560 aa, Artificial Sequence
  hemagglutinin_precursor__InfluenzaA__AAC40998
MNTQILILALVAIIPTNADKICLGHHAVSNGAKVNTLTERGVEVVNATETVERTNVPRICSKGKRTVDLGQCGLLGTITGPPQCDQFLEFSADLIIERREGNDVCYPGKFVNEEALRQILRKSGGIDKETMGFTYSGIRTNGATSACRRSGSSFYAEMKWLLSNTDNAAFPQMTKSYKNIRKDPALIIWGIHHSGSTAEQTKLYGSGNKLITVGSSNYQQSFVPSPGARPQVNGQSGRIDFHWLMLNPNDTVTFSFNGAFIAPDRASFLRGKSMGIQSEVQVDANCEGDCYHSGGTILSSLPFQNINSRTVGECPRYVKQESLLLATGMKNVPEIPKGRGLFGAIAGFIENGWEGLVDGWYGFRHQNAQGEGTAADYKSTQSAIDQITGKLNRLIEKTNQQFELIDNEFTEVEKQIGNVINWTRDSLTEMWSYNAELLVAMENQHTIDLADSEMNKLYERVRRQLRENAEEDGTGCFEIFHKCDDDCMASIRNNTYDHSKYREEAIQNRIQIDPVKLSSGYKDVILWFSFGASCFILLAIAMGLVFICVKNGNMRCTICI

SEQ ID NO: 13833 - protein, 560 aa, Artificial Sequence
  hemagglutinin_precursor__InfluenzaA__AAC40999
MNTQILILALVAIIPTNADKICLGHHAVSNGTKVNTLTERGVEVVNATETVERTNVPRICSKGKRTVDLGQCGLLGTITGPPQCDQFLEFSADLIIERREGDDVCYPGKFVNEEALRQILRESGGIDKETMGFTYSGIRTNGATSACRRSGSSFYAEMKWLLSNTDNAAFPQMTKSYKNIRKDPALIIWGIHHSGSTAEQTKLYGSGNKLITVGSSNYQQSFVPIPGARPQVNGQSGRIDFHWLMLNPNDTVTFSFNGAFIAPDRASFLRGKSMGIQSEVQVDANCEGDCYHSGGTILNNLPFQNINGRAVGKCPRYVKQESLLLATGMKNVPEIPKGRGLFGAIAGFIENGWEGLVDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAIQNRIQIDPVKLSSGYKDVILWFSFGASCFILLAIAMGLVFICVKNGNMRCTICI

SEQ ID NO: 13834 - protein, 565 aa, Artificial Sequence; identical to SEQ ID NO: 2488
  hemagglutinin__InfluenzaA__ACA28844

SEQ ID NO: 13835 - protein, 565 aa, Artificial Sequence; identical to SEQ ID NO: 7793
  hemagglutinin__InfluenzaA__ACA28844/m1

SEQ ID NO: 13836 - protein, 566 aa, Artificial Sequence; identical to SEQ ID NO: 9150
  hemagglutinin__InfluenzaA__ACV82259

SEQ ID NO: 13837 - protein, 566 aa, Artificial Sequence; identical to SEQ ID NO: 9150
  hemagglutinin__InfluenzaA__ACV82259/m1

SEQ ID NO: 13838 - protein, 566 aa, Artificial Sequence; identical to SEQ ID NO: 9150
  hemagglutinin__InfluenzaA__ACV82259/m2

SEQ ID NO: 13839 - protein, 566 aa, Artificial Sequence; identical to SEQ ID NO: 2667
  hemagglutinin__InfluenzaA__ACP41953

SEQ ID NO: 13840 - protein, 566 aa, Artificial Sequence; identical to SEQ ID NO: 12241
  hemagglutinin__InfluenzaA__AFM72832

SEQ ID NO: 13841 - protein, 566 aa, Artificial Sequence
  hemagglutinin__InfluenzaA__EPI516528
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLHCRICV

SEQ ID NO: 13842 - protein, 566 aa, Artificial Sequence
  hemagglutinin__InfluenzaA__AGM53850
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13843 - protein, 566 aa, Artificial Sequence
  hemagglutinin__InfluenzaA__EPI731463
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPNTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13844 - protein, 566 aa, Artificial Sequence; identical to SEQ ID NO: 4498
  hemagglutinin__InfluenzaA__EPI696972

SEQ ID NO: 13845 - protein, 566 aa, Artificial Sequence; identical to SEQ ID NO: 13686
  hemagglutinin__InfluenzaA__EPI662594

SEQ ID NO: 13846 - protein, 566 aa, Artificial Sequence
  hemagglutinin__InfluenzaA__EPI685579
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13847 - protein, 566 aa, Artificial Sequence
  hemagglutinin__InfluenzaA__EPI830230
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKMFKPEIATRPKVRDREGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13848 - protein, 566 aa, Artificial Sequence; identical to SEQ ID NO: 2656
  hemagglutinin__InfluenzaA__ACQ45338

SEQ ID NO: 13849 - protein, 566 aa, Artificial Sequence; identical to SEQ ID NO: 2656
  hemagglutinin__InfluenzaA__ACQ45338/m1

SEQ ID NO: 13850 - protein, 566 aa, Artificial Sequence; identical to SEQ ID NO: 2656
  hemagglutinin__InfluenzaA__ACQ45338/m2

SEQ ID NO: 13851 - protein, 566 aa, Artificial Sequence; identical to SEQ ID NO: 2318
  hemagglutinin__InfluenzaA__ACU79871

SEQ ID NO: 13852 - protein, 566 aa, Artificial Sequence
  hemagglutinin__InfluenzaA__ACU79871/m1
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIESRPWVRGQSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKVNRIIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRSGTYDHDVYRDEALNNRFQIKGVELKSGYKDWILWISFAISCFLLCVVLLGFIMWACQRGNIRCNICI

SEQ ID NO: 13853 - protein, 566 aa, Artificial Sequence
  hemagglutinin__InfluenzaA__EPI643118
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKLRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13854 - protein, 566 aa, Artificial Sequence; identical to SEQ ID NO: 12441
  hemagglutinin__InfluenzaA__EPI675798

SEQ ID NO: 13855 - protein, 566 aa, Artificial Sequence
  hemagglutinin__InfluenzaA__EPI578430
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSSCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13856 - protein, 566 aa, Artificial Sequence
  hemagglutinin__InfluenzaA__EPI614406
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSSCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13857 - protein, 564 aa, Artificial Sequence
  hemagglutinin__InfluenzaA__ACU65077/m1
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13858 - protein, 564 aa, Artificial Sequence; identical to SEQ ID NO: 13857
  hemagglutinin__InfluenzaA__ACU65077/m2

SEQ ID NO: 13859 - protein, 568 aa, Artificial Sequence; identical to SEQ ID NO: 28
  hemagglutinin__InfluenzaA__ABP51976

SEQ ID NO: 13860 - protein, 568 aa, Artificial Sequence; identical to SEQ ID NO: 28
  hemagglutinin__InfluenzaA__ABP51976/m1

SEQ ID NO: 13861 - protein, 564 aa, Artificial Sequence
  hemagglutinin__InfluenzaA__ABW90125
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSYWSSHEASLGVSSACPYQGKSSFFRNVVWLTKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13862 - protein, 564 aa, Artificial Sequence
  hemagglutinin__InfluenzaA__ABW90126
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKGSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13863 - protein, 564 aa, Artificial Sequence
  hemagglutinin__InfluenzaA__ABW90127
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGESSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13864 - protein, 564 aa, Artificial Sequence
  hemagglutinin__InfluenzaA__ABW90128
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIEKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13865 - protein, 564 aa, Artificial Sequence
  hemagglutinin__InfluenzaA__ABW90129
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSAYPTIKRSYNNTNQEDLLVLWGIHHPNDAAEQTELYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13866 - protein, 564 aa, Artificial Sequence
  hemagglutinin__InfluenzaA__ABW90130
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKFSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13867 - protein, 564 aa, Artificial Sequence
  hemagglutinin__InfluenzaA__ABW90132
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNNAAEQTELYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13868 - protein, 564 aa, Artificial Sequence
  hemagglutinin__InfluenzaA__ABW90133
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKPSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13869 - protein, 564 aa, Artificial Sequence
  hemagglutinin__InfluenzaA__ABW90134
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQEKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13870 - protein, 564 aa, Artificial Sequence
  hemagglutinin__InfluenzaA__ABW90135
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLINKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13871 - protein, 564 aa, Artificial Sequence
  hemagglutinin__InfluenzaA__HB649491
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13872 - protein, 560 aa, Artificial Sequence; identical to SEQ ID NO: 9988
  hemagglutinin__InfluenzaA__EPI439507

SEQ ID NO: 13873 - protein, 566 aa, Artificial Sequence
  hemagglutinin__InfluenzaA__EPI482777
MKAILVVLLYTFTTANADTLCIGYHANNSTDTVDTVLEKNVTVTHSVNLLENRHNGKLCKLRGVAPLHLGKCNIAGWLLGNPECESLSTASSWSYIVETSNSDNGTCYPGDFINYEELREQLSSVSSFERFEIFPKTSSWPNHDTNRGVTAACPHAGANSFYRNLVWLVKKGNSYPKINKSYINNKEKEVLVLWAIHHPSTSADQQSLYQNADAYVFVGSSRYSRKFEPEIATRPKVRDQAGRMNYYWTLVEPGDKITFEATGNLVAPRYAFALKRNSGSGIIISDTSVHDCDTTCQTPNGAINTSLPFQNIHPVTIGECPKYVKSTKLRMATGLRNIPSIQSRGLFGAIAGFIEGGWTGMIDGWYGYHHQNEQGSGYAADLKSTQNAIDGITNKVNSVIEKMNTQFTAVGKEFSHLERRIENLNKKVDDGFLDIWTYNAELLVLLENERTLDYHDSNVKNLYEKVRSQLKNNAKEIGNGCFEFYHKCDDMCMESVKNGTYDYPKYSEEAKLNREEIDGVKLESTRIYQILAIYSTVASSLVLVVSLGAISFWMCSNGSLQCRICI

SEQ ID NO: 13874 - protein, 566 aa, Artificial Sequence; identical to SEQ ID NO: 5584
  hemagglutinin__InfluenzaA__EPI745532

SEQ ID NO: 13875 - protein, 566 aa, Artificial Sequence
  hemagglutinin__InfluenzaA__EPI278594
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHESNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13876 - protein, 566 aa, Artificial Sequence
  hemagglutinin__InfluenzaA__AEE69009
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13877 - protein, 566 aa, Artificial Sequence; identical to SEQ ID NO: 2951
  hemagglutinin__InfluenzaA__GQ280797

SEQ ID NO: 13878 - protein, 566 aa, Artificial Sequence; identical to SEQ ID NO: 2684
  hemagglutinin__InfluenzaA__EPI178457

SEQ ID NO: 13879 - protein, 566 aa, Artificial Sequence; identical to SEQ ID NO: 2684
  hemagglutinin__InfluenzaA__EPI176470

SEQ ID NO: 13880 - protein, 566 aa, Artificial Sequence
  hemagglutinin__InfluenzaA__EPI280341
MKAILVVLLHTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPTLSKSYINDKGKEVLVLWGIHHPSTSADQQSLYQNADAYVFVGTSRYSKKFKPEIAIRPKVRNQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13881 - protein, 566 aa, Artificial Sequence
  hemagglutinin__InfluenzaA__EPI240319
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13882 - protein, 566 aa, Artificial Sequence; identical to SEQ ID NO: 2849
  hemagglutinin__InfluenzaA__EPI183134

SEQ ID NO: 13883 - protein, 566 aa, Artificial Sequence
  hemagglutinin__InfluenzaA__EPI368693
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTASCPHAGAKSFYKNLIWLVKKGNSYPKLSKSYINDKGKEVLVLWGIHHPSTSADQQSLYQNADAYVFVGSSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 13884 - protein, 566 aa, Artificial Sequence
  hemagglutinin__InfluenzaA__EPI291788
MKAILVVLLYTFTTANADTLCIGYHANNSTDTVDTVLEKNVTVTHSVNLLENRHNGKLCKLRGVAPLHLGKCNIAGWLLGNPECESLSTASSWSYIVETSNSDNGTCYPGDFINYEELREQLSSVSSFERFEIFPKTSSWPNHDTNRGVTAACPHAGTNSFYRNLIWLVKKGNSYPKINKSYINNKEKEVLVLWAIHHPSTSADQQSLYQNADAYVFVGSSRYSRKFEPEIATRPKVRDQAGRMNYYWTLVEPGDKITFEATGNLVVPRYAFALKRNSGSGIIISDTSVHDCDTTCQTPNGAINTSLPFQNIHPVTIGECPKYVKSTKLRMATGLRNIPSIQSRGLFGAIAGFIEGGWTGMIDGWYGYHHQNEQGSGYAADLKSTQNAIDGITNKVNSVIEKMNTQFTAVGKEFSHLERRIENLNKKVDDGFLDIWTYNAELLVLLENERTLDYHDSNVKNLYEKVRSQLKNNAKEIGNGCFEFYHKCDDTCMESVKNGTYDYPKYSEEAKLNREEIDGVKLESTRIYQILAIYSTVASSLVLVVSLGAISFWMCSNGSLQCRICI

SEQ ID NO: 13885 - protein, 566 aa, Artificial Sequence
  hemagglutinin__InfluenzaA__EPI482788
MKAILVVLLYTFTTANADTLCIGYHANNSTDTVDTVLEKNVTVTHSVNLLENRHNGKLCKLRGVAPLHLGKCNIAGWLLGNPECESLSTASSWSYIVETSNSDNGTCYPGDFINYEELREQLSSVSSFERFEIFPKTSSWPNHDTNRGVTAACPHAGTNSFYRNLIWLVKKGNSYPKINKSYINNKEKEVLVLWAIHHPSTSADQQSIYQNADAYVFVGSSRYSRKFEPEIATRPKVRDQAGRMNYYWTLVEPGDKITFEATGNLVVPRYAFALKRNSGSGIIISDTSVHDCDTTCQTPNGAINTSLPFQNIHPVTIGECPKYVKSTKLRMATGLRNIPSIQSRGLFGAIAGFIEGGWTGMIDGWYGYHHQNEQGSGYAADLKSTQNAIDGITNKVNSVIEKMNTQFTAVGKEFSHLERRIENLNKKVDDGFLDIWTYNAELLVLLENERTLDYHDSNVKNLYEKVRSQLKNNAKEIGNGCFEFYHKCDDTCMESVKNGTYDYPKYSEEAKLNREEIDGVKLESTRIYQILAIYSTVASSLVLVVSLGAISFWMCSNGSLQCRICI

SEQ ID NO: 13886 - protein, 566 aa, Artificial Sequence
  hemagglutinin__InfluenzaA__EPI178946/m1
MKAIIVVLLYTFATADADTLCIGYHANNSTDTVDTVLEKNVTVTHSVNLLENKHDGKLCKLRGVAPLHLGKCNIAGWLLGNPECESLFTASSWSYIVETPNSDNGTCYPGDFINYEELREHLSSVSSFERFEIFPKANSWPNHDTNKGVTAACPYAGANSFYRNLIWLVKKGNSYPKLSKSYINNKKKEVLVIWGIHHPPTSTDQQTLYQNADAYVFVGSSKYSKRFKPEIAARPKVRNQAGRMNYYWTLIEPGDTITFEATGNLVVPRYAFAMKRGSGSGIIVSDAPVHDCNTTCQTPKGAINTSLPFQNIHPVTIGECPKYVKSTKLRMATGLRNIPSIQSRGLFGAIAGFLEGGWTGMIDGWYGYHHQNEQGSGYAADQKSTQNAIDGITNKVNSIIEKMNTQFTAVGKEFNQLEKRIESLNNKVDDGFLDIWTYNAEMLVLLENERTLDYHDSNVKNLYEKVRSQLKNNAKEIGNGCFEFYHKCDNTCMESVKNGTYDYPKYSEEAKLNREEIDGVKLESARIYQILAIYSTVASSLVLLVSLGAVSFWMCSNGSLQCRICI

SEQ ID NO: 13887 - protein, 566 aa, Artificial Sequence
  hemagglutinin__InfluenzaA__EPI482791/m2
MKAIIVVLLYTFATADADTLCIGYHANNSTDTVDTVLEKNVTVTHSVNLLENKHDGKLCKLRGVAPLHLGKCNIAGWLLGNPECESLFTASSWSYIVETPNSDNGTCYPGDFINYEELREHLSSVSSFERFEIFPKANSWPNHETNKGVTAACPYAGANSFYRNLIWLVKKGNSYPKLSKSYINNKKKEVLVIWGIHHPPTSTDQQTLYQNADAYVFVGSSKYSKRFKPEIAARPKVRNQAGRMNYYWTLIEPGDTITFEATGNLVVPRYAFAMKRGSGSGIIVSDAPVHDCNTTCQTPKGAINTSLPFQNIHPVTIGECPKYVKSTKLRMATGLRNIPSIQSRGLFGAIAGFLEGGWTGMIDGWYGYHHQNEQGSGYAADQKSTQNAIDGITNKVNSIIEKMNTQFTAVGKEFNQLEKRIESLNNKVDDGFLDIWTYNAEMLVLLENERTLDYHDSNVKNLYEKVRSQLKNNAKEIGNGCFEFYHKCDNTCMESVKNGTYDYPKYSEEAKLNREEIDGVKLESARIYQILAIYSTVASSLVLLVSLGAVSFWMCSNGSLQCRICI

SEQ ID NO: 13888 - protein, 566 aa, Artificial Sequence
  hemagglutinin__InfluenzaA__EPI291799
MKAILVVLLYTFTTANADTLCIGYHANNSTDTVDTVLEKNVTVTHSVNLLENRHNGKLCKLRGVAPLHLGKCNIAGWLLGNPECESLSTASSWSYIVETSNSDNGTCYPGDFINYEELREQLSSVSSFERFEIFPKTSSWPNHDTNRGVTAACPHAGTNSFYRNLIWLVKKGNSYPKINKSYINNKEKEVLVLWAIHHPSTSADQQSLYQNADAYVFVGSSRYSRKFEPEIATRPKVRDQAGRMNYYWTLVEPGDKITFEATGNLVVPRYAFALKRTSGSGIIISDTSVHDCDTTCQTPNGAINTSLPFQNIHPVTIGECPKYVKSTKLRMATGLRNIPSIQSRGLFGAIAGFIEGGWTGMIDGWYGYHHQNEQGSGYAADLKSTQNAIDGITNKVNSVIEKMNTQFTAVGKEFSHLERRIENLNKKVDDGFLDIWTYNAELLVLLENERTLDYHDSNVKNLYEKVRSQLKNNAKEIGNGCFEFYHKCDDTCMESVKNGTYDYPKYSEEAKLNREEIDGVKLESTRIYQILAIYSTVASSLVLVVSLGAISFWMCSNGSLQCRICI

SEQ ID NO: 13889 - protein, 566 aa, Artificial Sequence
  hemagglutinin__InfluenzaA__EPI482799
MKAILVVLLYTFTTANADTLCIGYHANNSTDTVDTVLEKNVTVTHSVNLLENRHNGKLCKLRGVAPLHLGKCNIAGWLLGNPECESLSTASSWSYIVETSNSDNGTCYPGDFINYEELREQLSSVSSFERFEIFPKTSSWPNHETNRGVTAACPHAGTNSFYRNLIWLVKKGNSYPKINKSYINNKEKEVLVLWAIHHPSTSADQQSLYQNADAYVFVGSSRYSRKFEPEIATRPKVRDQAGRMNYYWTLVEPGDKITFEATGNLVVPRYAFALKRTSGSGIIISDTSVHDCDTTCQTPNGAINTSLPFQNIHPVTIGECPKYVKSTKLRMATGLRNIPSIQSRGLFGAIAGFIEGGWTGMIDGWYGYHHQNEQGSGYAADLKSTQNAIDGITNKVNSVIEKMNTQFTAVGKEFSHLERRIENLNKKVDDGFLDIWTYNAELLVLLENERTLDYHDSNVKNLYEKVRSQLKNNAKEIGNGCFEFYHKCDDTCMESVKNGTYDYPKYSEEAKLNREEIDGVKLESTRIYQILAIYSTVASSLVLVVSLGAISFWMCSNGSLQCRICI

SEQ ID NO: 13890 - protein, 566 aa, Artificial Sequence
  hemagglutinin__InfluenzaA__EPI291807
MKAIIVVLLYTFATADADTLCIGYHANNSTDTVDTVLEKNVTVTHSVNLLENKHDGKLCKLRGVAPLHLGKCNIAGWLLGNPECESLFAASSWSYIVETPNSDNGTCYPGDFINYEELREHLSSVSSFERFEIFPKANSWPNHDTNKGVTAACPYAGANSFYRNLIWLVKKGNSYPKLSKSYINNKKKEVLVIWGIHHPPTSTDQQTLYQNADAYVFVGSSKYSKRFKPEIAARPKVRDQAGRMDYYWTLIEPGDTITFEATGNLVVPRYAFAMKRGSGSGIIVSDAPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADQKSTQNAIDGITNKVNSIIEKMNTQFTAVGKEFSQLEKRIESLNNKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESARIYQILAIYSTVASSLVLLVSLGAVSFWMCSNGSLQCRICI

SEQ ID NO: 13891 - protein, 566 aa, Artificial Sequence
  hemagglutinin__InfluenzaA__EPI638970
MKAILVVLLYTFTTANADTLCIGYHANNSTDTVDTVLEKNVTVTHSVNLLENRHNGKLCKLRGVAPLHLGKCNIAGWILGNPECESLSTASSWSYIVETSNSENGTCYPGDFINYEELREQLSSVSSFERFEIFPKTSSWPNHDTNKGVTAACPHSGTNSFYRNLVWLVQKGNSYPKINKSYINNKENEVLVLWAIHHPSTSADQQSLYKNADAYVFVGSSRYSRKFEPEIATRPKVRDQAGRMNYYWTLVEPGDKITFEATGNLVAPRYAFTLKRNSGSGIIISDTSVHDCDTTCQTPNGAINTSLPFQNIHPVTIGECPKYVKSTKLRMATGLRNIPSIQSRGLFGAIAGFIEGGWTGMIDGWYGYHHQNEQGSGYAADLKSTQNAIDGITNKVNSVIEKMNTQFTAVGKEFSHLERRIENLNKKVDDGFLDIWTYNAELLVLLENERTLDYHDSNVKNLYEKVRSQLKNNAKEIGNGCFEFYHKCDDMCMESVKNGTYDYPKYSEEAKLNREEIDGVKLESTKIYQILAIYSTVASSLVLVVSLGAISFWMCSNGSLQCRICI

SEQ ID NO: 13892 - protein, 566 aa, Artificial Sequence
  hemagglutinin__InfluenzaA__ABI19015
MKAIIVVLLYTFATADADTLCIGYHANNSTDTVDTVLEKNVTVTHSVNLLENKHDGKLCKLRGIAPLHLGKCNIAGWILGNPECESLFTTSSWSYIVETPNSDNGTCYPGDFINYEELREHLSSVSSFERFEIFPKANSWPYHDTNKGVTAACPYAGANSFYRNLIWLVKKGNSYPKLSKSYINNKKKEVLVIWGIHHPPTSTDQQTLYQNADAYVFVGSSKYSKRFKPEIAARPKVRDQAGRMDYYWTLIEPGDTITFEATGNLVVPRYAFTMKRGSGSGIIVSDAPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADQKSTQNAIDGITNKVNSIIEKMNTQFTAVGKEFSQLEKRIESLNNKVDDGFLDIWTYNAELLVLLENERTLDYHDSNVKNLYEKVRSQLKNNAKEIGNGCFEFYHKCDDTCMESVKNGTYDYPKYSEEAKLNRQEIDGVKLESARIYQILAIYSTVASSLVLLVSLGAVSFWMCSNGSLQCRICI

SEQ ID NO: 13893 - protein, 566 aa, Artificial Sequence
  hemagglutinin__InfluenzaA__EPI687790
MKAILVVLLYTFTTANADTLCIGYHANNSTDTVDTVLEKNVTVTHSVNLLEDKHNGKLCKLGGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13894 - protein, 566 aa, Artificial Sequence
  hemagglutinin__InfluenzaA__EPI841265
MKAILVVLLYTFTTANADTLCIGYHANNSTDTVDTVLEKNVTVTHSVNLLEDKHNGKLCKLGGVAPLHLGKCNIAGWILGNPECESLSTASSWSYIVETSNSDNGTCYPGDFINYEELREQLSSVSSFERFEIFPKTSSWPNHDSNKGVTAACPHAGAKSFYKNLIWLVKKGNSYPKLNQSYINDKGKEVLVLWGIHHPSTTADQQSIYQNADAYVFVGTSRYSKKFKPEIATRPKVRDQEGRINYYWTLVEPGDKITFEATGNLVVPRYAFTMERNAGSGIIISNTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13895 - protein, 566 aa, Artificial Sequence
  hemagglutinin__InfluenzaA__EPI291846
MKAIIVVLLYTFATADADTLCIGYHANNSTDTVDTVLEKNVTVTHSVNLLENKHDGKLCNLKGVAPLHLGKCNIAGWLLGNPECESLFTASSWSYIVETPNSDNGTCYPGDFINYEELREHLSSVSSFERFEIFPKVNSWPNHDTNKGVTAACPYAGANSFYRNLIWLVKKGNSYPKLSKSYINNKKKEVLVIWGIHHPPTSTDQQTLYQNADAYVFVGSSKYSKRFEPEIAARPKVRNQAGRMNYYWTLIEPGDTITFEATGNLVVPRYAFAMRRGSGSGIIVSDAPVHDCNTTCQTPKGAINTSLPFQNIHPVTIGECPKYVKSTKLRMATGLRNIPSIQSRGLFGAIAGFLEGGWTGMIDGWYGYHHQNEQGSGYAADQKSTQNAIDGITNKVNSIIEKMNTQFTAVGKEFSQLEKRIESLNNKVDDGFLDIWTYNAEMLVLLENERTLDYHDSNVKNLYEKVRSQLKNNAKEIGNGCFEFYHKCDNTCMESVRNGTYDYPKYSEEAKLNREEIDGVKLESARIYQILAIYSTVASSLVLLVSLGAVSFWMCSNGSLQCRICI

SEQ ID NO: 13896 - protein, 564 aa, Artificial Sequence
  hemagglutinin__InfluenzaA__EPI558121
MKAILVVLLYTFTTANADTLCIGYHANNSTDTVDTVLEKNVTVTHSVNLLENRHNGKLCKLRGVAPLHLGKCNIAGWLLGNPECESLSTASSWSYIVETSNSDNGTCYPGDFINYEELREQLSSVSSFERFEIFPQTSSWPNHDTNRGVTAACPHAGTNSFYRNLVWLVKKGNSYSKINKSYINNKEKEVLVLWAIHHPSTSADQQSLYQNADAYVFVGSSRYSRKFEPEIATRPKVRDQAGRMNYYWTLVEPGDKITFEATGNLVAPRYAFALKRNSGSGIIISDTSVHDCDTTCQTPNGAINTSLPFQNIHPVTIGECPKYVKSTKLRMATGLRNIPSIQSRGLFGAIAGFIEGGWTGMIDGWYGYHHQNEQGSGYAADLKSTQNAIDGITNKVNSVIEKMNTQFTAVGKEFSHLERRIENLNKKVDDGFLDIWTYNAELLVLLENERTLDYHDSNVKNLYEKVRSQLKNNAKEIGNGCFEFYHKCDDMCMESVKNGTYDYPKYSEEAKLNREEIDGVKLESTRIYQILAIYSTVASSLVLVVSLGAISFWMCSNGSLQCRI

SEQ ID NO: 13897 - protein, 566 aa, Artificial Sequence; identical to SEQ ID NO: 12441
  hemagglutinin__InfluenzaA__EPI564139

SEQ ID NO: 13898 - protein, 566 aa, Artificial Sequence; identical to SEQ ID NO: 13686
  hemagglutinin__InfluenzaA__EPI786706

SEQ ID NO: 13899 - protein, 566 aa, Artificial Sequence
  hemagglutinin__InfluenzaA__EPI395313
MKAILIVLLYTFTTANADTLCIGYHANNSTDTVDTVLEKNVTVTHSVNLLENRHNGKLCKLRGVAPLHLGKCNIAGWLLGNPECESLSTASSWSYIVETSNSDNGTCYPGDFINYEELREQLSSVSSFERFEIFPKTSSWPNHDTNRGVTAACPHAGTKSFYKNLIWIAKKGNSYPKINKSYINNKEKEVLVLWAIHHPSTSADQQSLYQNADAYVFVGSSRYSRKFEPEIATRPKVRDQAGRMNYYWTLVEPGDKITFEATGNLVAPRYAFALKRNSGSGIIISDTSVHDCDTTCQTPNGAINTSLPFQNIHPVTIGECPKYVKSTKLRMATGLRNIPSIQSRGLFGAIAGFIEGGWTGMIDGWYGYHHQNEQGSGYAADLKSTQNAIDGITNKVNSVIEKMNTQFTAVGKEFSHLERRIENLNKKVDDGFLDIWTYNAELLVLLENERTLDYHDSNVKNLYEKVRSQLKNNAKEIGNGCFEFYHKCDDMCMESVKNGTYDYPKYSEEAKLNREVIDGVKLESTRIYQILAIYATVASSLVLVVSLGAISFWMCSNGSLQCRICI

SEQ ID NO: 13900 - protein, 566 aa, Artificial Sequence
  hemagglutinin__InfluenzaA__EPI291696
MKAILLVLLYTFTAANADTLCIGYHANNSTDTVDTVLEKNVTVTHSVNLLENRHNGKLCKLRGVPPLHLGKCNIAGWLLGNPECELLFTASSWSYIVETSNSDNGTCYPGDFINYEELREQLSSVSSFERFEIFPKASSWPDHETNRGVTAACPYAGANSFYRNLIWLVKKGNSYPKLSKSYVNNKEKEVLVLWGIHHPPTSTDQQSLYQNADAYVFVGSSKYNKKFKPEMAARPKVRGQAGRMNYYWTLVAPGDTITFEATGNLVVPRYAFAMKRGSGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNKKVDDGFLDVWTYNAELLVLLENERTLDYHDSNVKNLYEKVRSQLKNNAKEIGNGCFEFYHKCDDTCMESVKNGTYDYPKYSEESKLNREEIDGVKLESTRIYQILAIYSTVASSLVLSVSLGAISFWMCSNGSLQCRICI

SEQ ID NO: 13901 - protein, 566 aa, Artificial Sequence; identical to SEQ ID NO: 9831
  hemagglutinin__InfluenzaA__ACU80014

SEQ ID NO: 13902 - protein, 566 aa, Artificial Sequence; identical to SEQ ID NO: 2669
  hemagglutinin__InfluenzaA__EPI177400

SEQ ID NO: 13903 - protein, 566 aa, Artificial Sequence; identical to SEQ ID NO: 3112
  hemagglutinin__InfluenzaA__ACT36512

SEQ ID NO: 13904 - protein, 567 aa, Artificial Sequence
  hemagglutinin__InfluenzaA__AJE30344
MEKIVLLLAVISLVKSDQICIGYHANNSTKQVDTIMEKNVTVTHAQDILEKTHNGKLCDLNGVKPLILKDCSVAGWLLGNPMCDEFIRVPEWSYIVERANPANDLCYPGTLNDYEELKHLLSRINHFEKNLIIPRSSWPNHETSLGVSAACPYQGASSFFRNVVWLIKKNDAYPTIKISYNNTNREDLLILWGIHHSNNAAEQTNLYKNPDTYVSVGTSTLNQRLVPKIATRSQVNGQSGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPKYSEEAILKREEISGVKLESIGTYQILSIYSTVASSLALAIIVAGLSLWMCSNGSLQCRICI

SEQ ID NO: 13905 - protein, 566 aa, Artificial Sequence; identical to SEQ ID NO: 13884
  hemagglutinin__InfluenzaA__EPI178948

SEQ ID NO: 13906 - protein, 566 aa, Artificial Sequence; identical to SEQ ID NO: 13884
  hemagglutinin__InfluenzaA__EPI178949

SEQ ID NO: 13907 - protein, 566 aa, Artificial Sequence
  hemagglutinin__InfluenzaA__EPI590132
MKAILIVLLYTFTTANADKICIGYHANNSTDTVDTVLEKNVTVTHSVNLLENKHNGKLCKLRGVAPLHLGKCNIAGWLLGNPECESLATASSWSYIVETSSSNNGTCYPGDFINYEELREQLSSVSSFEKFEIFPKTSSWPNHETNKGVTAACPHAGTNSFYKNLIWLVKKENSYPKINISYTNNRGKEVLVLWAIHHPPTSTDQQSLYQNANSYVFVGSSRYSRKFEPEIATRPKVRGQAGRMNYYWTLVEPGDKITFEATGNLVVPRYAFALKRNSGSGIIISETPVHDCDTTCQTPNGAINTSLPFQNIHPVTIGECPKYVKSTKLRMATGLRNIPSIQSRGLFGAIAGFIEGGWTGMIDGWYGYHHQNEQGSGYAADLKSTQNAIDGITNKVNSVIEKMNTQFTAVGKEFSHLERRIENLNKKVDDGFIDIWTYNAELLVLLENERTLDYHDSNVKTLYEKVRSQLKNNAKEIGNGCFEFYHKCDDTCMESVKNGTYDYPKYSEEAKLNREEIDGIKLESTRIYQILAIYSTVASSLVLVVSLGAISFWMCSNGSLQCRVCI

SEQ ID NO: 13908 - protein, 566 aa, Artificial Sequence; identical to SEQ ID NO: 1736
  hemagglutinin__InfluenzaA__ABU80400

SEQ ID NO: 13909 - protein, 565 aa, Artificial Sequence
  hemagglutinin__InfluenzaA__ABO21709
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNNPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 13910 - protein, 566 aa, Artificial Sequence; identical to SEQ ID NO: 2656
  hemagglutinin__InfluenzaA__CAZ65588

SEQ ID NO: 13911 - protein, 566 aa, Artificial Sequence; identical to SEQ ID NO: 13686
  hemagglutinin__InfluenzaA__EPI697744

SEQ ID NO: 13912 - protein, 566 aa, Artificial Sequence; identical to SEQ ID NO: 13846
  hemagglutinin__InfluenzaA__EPI768525

SEQ ID NO: 13913 - protein, 566 aa, Artificial Sequence
  hemagglutinin__InfluenzaA__EPI726930
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKASSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13914 - protein, 566 aa, Artificial Sequence
  hemagglutinin__InfluenzaA__EPI813817
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKASSWPNHDSNKGVTAACPHAGAKSFYKNLIWLVKKGNSYPKLNQSYINDKGKEVLVLWGIHHPSTTADQQSLYQNADAYVFVGTSRYSKKFKPEIATRPKVRDQEARMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 13915 - protein, 566 aa, Artificial Sequence
  hemagglutinin__InfluenzaA__EPI466626
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSVVLVVSLGAISFWMCSNGSLQCRICI

SEQ ID NO: 13916 - protein, 566 aa, Artificial Sequence
  hemagglutinin__InfluenzaA__EPI541966
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHESNKGVTAACPHAGAKSFYKNLIWLVKKGNSYPKLSQSYINDKGKEVLVLWGIHHPSTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSVVLVVSLGAISFWMCSNGSLQCRICI

SEQ ID NO: 13917 - protein, 566 aa, Artificial Sequence
  hemagglutinin__InfluenzaA__EPI652003
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHESNKGVTAACPHAGAKSFYKNLIWLVKKGNSYPKLSQSYINDKGKEVLVLWGIHHPPTTADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREKIDGVKLESTRIYQILAIYSTVASSVVLVVSLGAISFWMCSNGSLQCRICI

SEQ ID NO: 13918 - protein, 566 aa, Artificial Sequence
  hemagglutinin__InfluenzaA__EPI291877
MKAIIVVLLYTFATADADTLCIGYHANNSTDTVDTVLEKNVTVTHSVNILENKHDGKLCKLRGVAPLHLGKCNIAGWLLGNPECESLFAASSWSYIVETPNSDNGTCYPGDFINYEELREHLSSVSSFERFEIFPKANSWPNHDTNKGVTAACPYAGANSFYRNLIWLVKKGNSYPKLSKSYINNKKKEVLVIWGIHHPPTSIDQQTLYQNADAYVFVGSSKYSKRFKPEIAARPKVRDQAGRMDYYWTLIEPGDTITFEATGNLVVPRYAFAMKRGSGSGIIVSDAPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADQKSTQNAIDGITNKVNSIIEKMNTQFTAVGKEFSQLEKRIESLNNKVDDGFLDIWTYNAELLVLLENERTLDYHDSNVKNLYEKVRSQLKNNAKEIGNGCFEFYHKCDNTCMESVKNGTYDYPKYSEEAKLNREEIDGIKLESARIYQILAIYSTVASSLVLLVSLGAVSFWMCSNGSLQCRICI

SEQ ID NO: 13919 - protein, 566 aa, Artificial Sequence
  hemagglutinin__InfluenzaA__ABR29595
MKAILLVLLYTFTAANADTLCIGYHANNSTDTVDTVLEKNVTVTHSVNLLEDRHNGKLCKLRGVAPLHLGKCNIAGWLLGNPECELLFTASSWSYIVETSNSDNGTCYPGDFINYEELREQLSSVSSFERFEIFPKASSWPNHETNRGVTAACPYAGANSFYRNLIWLVKKGNSYPKLSKSYVNNKEKEVLVLWGIHHPPTSTDQQSLYQNADAYVFVGSSKYNKKFKPEIATRPKVRGQAGRMNYYWTLVEPGDTITFEATGNLVVPRYAFAMKRGSGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNKKVDDGFLDVWTYNAELLVLLENERTLDYHDSNVKNLYEKVRSQLKNNAKEIGNGCFEFYHKCDDTCMESVKNGTYDYPKYSEESKLNREEIDGVKLESTRIYQILAIYSTVASSLVLLVSLGAISFWMCSNGSLQCRICI

SEQ ID NO: 13920 - protein, 566 aa, Artificial Sequence
  hemagglutinin__InfluenzaA__EPI291885
MKAIIVVLLHTFATADADTLCIGYHANNSTDTVDTVLEKNVTVTHSVNLLETKHDGKLCNLKGVAPLHLGKCNIAGWLLGNPECESLFTASSWSYIVETPNSDNGTCYPGNFINYEELREHLSSVSSFERFEIFPKANSWPNHDTNKGVTAACPYAGANSFYRNLIWLVKKGNSYPKLSKSYINNKKKEVLVIWGIHHPPTSTDQQTLYQNADAYVFVGSSKYSKRFEPEIAARPKVRNQAGRMNYYWTLIEPGDTITFEATGNLVVPRYAFAMRRGSGSGIIVSDAPVHDCNTTCQTPKGAINTSLPFQNIHPVTIGECPKYVKSTKLRMATGLRNIPSIQSRGLFGAIAGFLEGGWTGMIDGWYGYHHQNEQGSGYAADQKSTQNAIDGITNKVNSIIEKMNTQFTAVGKEFSQLEKRIESLNNKVDDGFLDIWTYNAEMLVLLENERTLDYHDSNVKNLYEKVRSQLKNNAKEIGNGCFEFYHKCDNTCMESVKNGTYDYPKYSEEAKLNREEIDGVKLESARIYQILAIYSTVASSLVLLVSLGAVSFWMCSNGSLQCRICI

SEQ ID NO: 13921 - protein, 566 aa, Artificial Sequence; identical to SEQ ID NO: 2656
  hemagglutinin__InfluenzaA__EPI176515

SEQ ID NO: 13922 - protein, 566 aa, Artificial Sequence; identical to SEQ ID NO: 3112
  hemagglutinin__InfluenzaA__EPI189182

SEQ ID NO: 13923 - protein, 566 aa, Artificial Sequence; identical to SEQ ID NO: 2904
  hemagglutinin__InfluenzaA__EPI180574

SEQ ID NO: 13924 - protein, 566 aa, Artificial Sequence; identical to SEQ ID NO: 8709
  hemagglutinin__InfluenzaA__EPI377499

SEQ ID NO: 13925 - protein, 566 aa, Artificial Sequence
  hemagglutinin__InfluenzaA__EPI346916
MKAILVVLLYTFTTATADTLCIGYHANNSTDTVDTVLEKNVTVTHSVNLLENRHNGKLCKLRGVAPLHLGKCNIAGWLLGNPECESLSTASSWSYIVETSNSDNGTCYPGDFINYEELREQLSSVSSFERFEIFPKTSSWPNHDTNRGVTAACPHDGTNSFYRNLIWLVKKGNSYPKINKSYINNKEKEILVLWAIHHPSTSADQQSLYQNADAYVFVGSSRYSRKFEPEVATRPKVRDQAGRMNYYWTLVEPGDKITFEATGNLVVPRYAFALKRNSGSGIIISDTSVHDCDTNCQTPNGAINTSLPFQNIHPVTIGECPKYVKSTKLRMATGLRNIPSIQSRGLFGAIAGFIEGGWTGMIDGWYGYHHQNEQGSGYAADLKSTQNAIDGITNKVNSVIEKMNTQFTAVGKEFSHLERRIENLNKKVDDGFLDIWTYNAELLVLLENERTLDYHDSNVKNLYEKVRSQLKNNAKEIGNGCFEFYHKCDDMCMESVKNGTYDYPKYSEEAKLNREEIDGVKLESTRIYQILAIYSTVASSLVLVVSLGAISFWMCSNGSLQCRICI

SEQ ID NO: 13926 - protein, 562 aa, Artificial Sequence; identical to SEQ ID NO: 3283
  hemagglutinin__InfluenzaA__ACV49600

SEQ ID NO: 13927 - protein, 566 aa, Artificial Sequence; identical to SEQ ID NO: 2329
  hemagglutinin__InfluenzaA__BAF48361

SEQ ID NO: 13928 - protein, 566 aa, Artificial Sequence
  hemagglutinin__InfluenzaA__EPI507594
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACKRGSNSSFFSRLNWLTHLNFKYPALNVTMPNNEQFDKLYIWGVHHPVTDKDQIFLYAQSSGRITVSTKRSQQAVIPNIGFRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNFEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13929 - protein, 566 aa, Artificial Sequence
  hemagglutinin__InfluenzaA__EPI461953
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACIRGSNSSFFSRLNWLTHLNFKYPALNVTMPNNEQFDKLYIWGVHHPGTDKDQIFLYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNFEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13930 - protein, 566 aa, Artificial Sequence
  hemagglutinin__InfluenzaA__EPI461953/m1
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACKRGSNSSFFSRLNWLTHLNFKYPALNVTMPNNEQFDKLYIWGVHHPVTDKDQIFLYAQSSGRITVSTKRSQQAVIPNIGYRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNFEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13931 - protein, 566 aa, Artificial Sequence
  hemagglutinin__InfluenzaA__EPI668105
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRGSSSSFFSRLNWLTHLNYKYPALNVTMPNNEQFDKLYIWGVHHPGTDKDQIFPYAQSSGRITVSTKRSQQAVIPNIGSRPRIRGIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13932 - protein, 566 aa, Artificial Sequence
  hemagglutinin__InfluenzaA__EPI578446
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRITVSTKRSQQAVIPNIGSRPRIRGIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13933 - protein, 566 aa, Artificial Sequence; identical to SEQ ID NO: 12441
  hemagglutinin__InfluenzaA__EPI551882

SEQ ID NO: 13934 - protein, 566 aa, Artificial Sequence
  hemagglutinin__InfluenzaA__EPI344389
MKTIIAFSCILCLIFAQKLPGSDNSMATLCLGHHAVPNGTLVKTITDDQIEVTNATELVQSSSTGRICNSPHQILDGKNCTLIDALLGDPHCDDLQNKEWDLFVERSTAYSNCYPYYVPDYATLRSLVASSGNLEFTQESFNWTGVAQDGSSYACRRGSVNSFFSRLNWLYNLNYKYPEQNVTMPNNDKFDKLYIWGVHHPGTDKDQTNLYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRRQLRENAEDMGNGCFKIYHKCDNACIGSIRNGTYDHDIYRNEALNNRFQIKGVQLKSGYKDWILWISFAISCFLLCVVLLGFIMWACQKGNIRCNICI

SEQ ID NO: 13935 - protein, 566 aa, Artificial Sequence
  hemagglutinin__InfluenzaA__EPI348782
MKTIIAFSCILCLIFAQKLPGSDNSMATLCLGHHAVPNGTLVKTITDDQIEVTNATELVQSSSTGRICNSPHQILDGKNCTLIDALLGDPHCDDLQNKEWDLFVERSTAYSNCYPYYVPDYATLRSLVASSGNLEFTQESFNWTGVAQDGSSYACRRGSVNSFFSRLNWLYKLNYKYPEQNVTMPNNDKFDKLYIWGVHHPGTDKDQTNIYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRRQLRENAEDMGNGCFKIYHKCDNACIGSIRNGTYDHDIYRNEALNNRFQIKGVQLKSGYKDWILWISFAISCFLLCVVLLGFIMWACQKGNIRCNICI

SEQ ID NO: 13936 - protein, 566 aa, Artificial Sequence
  hemagglutinin__InfluenzaA__EPI642513
MKTIIAFSCILCLIFAQKLPGSDKSMATLCLGHHAVPNGTLVKTITDDQIEVTNATELVQSSSTSRICNSPHQILDGKNCTLIDALLGDPHCDDFQNKKWDLFVERSTAYSNCYPYYVPDYATLRSLIASSGNLEFTQESFNWTGVAQDGSSYACRRGSVNSFFSRLNWLYNLNYKYPEQNVTMPNNDKFDKLYIWGVHHPGTDKDQTNLYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRRQLRENAEDMGNGCFKIYHKCDNACIGSIRNGTYDHDIYRNEALNNRFQIKGVQLKSGYKDWILWISFAISCFLLCVVLLGFIMWACQKGNIRCNICI

SEQ ID NO: 13937 - protein, 566 aa, Artificial Sequence
  hemagglutinin__InfluenzaA__EPI293965
MKTIIAFSCILCLIFAQKLPGSDNSMATLCLGHHAVPNGTLVKTITDDQIEVTNATELVQSSSTGRICNSPHQILDGKNCTLIDALLGDPHCDDFQNKEWDLFVERSTAYSNCYPYYVPDYATLRSLVASSGNLEFTQESFNWTGVAQDGSSYACRRGSVNSFFSRLNWLYNLNYKYPEQNVTMPNNDKFDKLYIWGVHHPGTDKDQTNLYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRRQLRENAEDMGNGCFKIYHKCDNACIGSIRNGTYDHDIYRNEALNNRFQIKGVQLKSGYKDWILWISFAISCFLLCVVLLGFIMWACQKGNIRCNICI

SEQ ID NO: 13938 - protein, 566 aa, Artificial Sequence
  hemagglutinin__InfluenzaA__EPI465400
MKTIIAFSCILCLIFAQKLPGSDNSMATLCLGHHAVPNGTLVKTITDDQIEVTNATELVQSSSTGRICNSPHQILDGKNCTLIDALLGDPHCDDFQNKEWDLFVERSTAYSNCYPYYVPDYATLRSLVASSGNLEFTQESFNWTGVAQDGSSYACRRGSVNSFFSRLNWLYNLNYKYPEQNVTMPNNDKFDKLYIWGVHHPGTDKDQTKLYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRRQLRENAEDMGNGCFKIYHKCDNACIGSIRNGTYDHDIYRNEALNNRFQIKGVQLKSGYKDWILWISFAISCFLLCVVLLGFIMWACQKGNIRCNICI

SEQ ID NO: 13939 - protein, 566 aa, Artificial Sequence
  hemagglutinin__InfluenzaA__EPI328898
MKTIIAFSCILCLIFAQKLPGSDNSMATLCLGHHAVPNGTLVKTITDDQIEVTNATELVQSSSTGRICNSPHQILDGKNCTLIDALLGDPHCDDFQNKEWDLFVERSTAYSNCYPYYVPDYATLRSLVASSGNLEFTQESFNWTGVAQDGSSYACRRGSVNSFFSRLNWLYNLNYKYPEQNVTMPNNDKFDKLYIWGVHHPGTDKDQTKIYVQASGRVIVSTKRSQQTVIPNIGSRPWVRGVSSIISIYWTIVKPGDILLINSTGNLIAPRGYFKIQSGKSSIMRSDAHIDECNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMSKLFERTRRQLRENAEDMGNGCFKIYHKCDNACIGSIRNGTYDHDIYRNEALNNRFQIKGVQLKSGYKDWILWISFAISCFLLCVVLLGFIMWACQKGNIRCNICI

SEQ ID NO: 13940 - protein, 566 aa, Artificial Sequence; identical to SEQ ID NO: 13939
  hemagglutinin__InfluenzaA__EPI328900

SEQ ID NO: 13941 - protein, 566 aa, Artificial Sequence
  hemagglutinin__InfluenzaA__EPI574644
MKTIIALSYILCLVFAQKLPGNDNSTATLCLGHHAVPNGTIVKTITNDRIEVTNATELVQNSSIGEICDSPHQILDGKNCTLIDALLGDPQCDGFQNKRWDLFVERSKAYSNCYPYDVPDYASLRSLVASSGTLEFNDESFNWAGVTQNGTSSACIRGSNSSFFSRLNWLTHSNFKYPALNVTMPNNEQFDKLYIWGVHHPGTDKDQIFLYAHSSGRITVSTKRSQQAVIPNIGSRPRIRNIPSRISIYWTIVKPGDILLINSTGNLIAPRGYFKIQSGKSSIMRSDAPIGKCKSECITPNGSIPNDKPFQNVNRITYGACPRYVKQSTLKLATGMRNVPEKQTRGIFGAIAGFIENGWEGMKDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13942 - protein, 566 aa, Artificial Sequence
  hemagglutinin__InfluenzaA__EPI563212
MKTIIALSYILCLVFAQKIPGNDNNTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRITVSTKRSQQAVIPNIGSRPRIRGIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13943 - protein, 566 aa, Artificial Sequence; identical to SEQ ID NO: 13942
  hemagglutinin__InfluenzaA__EPI553999

SEQ ID NO: 13944 - protein, 566 aa, Artificial Sequence
  hemagglutinin__InfluenzaA__EPI551570
MKTIIALSYILCLVFAQKIPGNDNNTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYTYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13945 - protein, 566 aa, Artificial Sequence
  hemagglutinin__InfluenzaA__EPI629738
MKTIIALSYILCLVFAQKIPGNDNNTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13946 - protein, 566 aa, Artificial Sequence
  hemagglutinin__InfluenzaA__EPI631887
MKTIIALSYILCLVFAQKIPGNDNNTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDSPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13947 - protein, 566 aa, Artificial Sequence
  hemagglutinin__InfluenzaA__EPI577026
MKTIIALSYILCLVFAQKIPGNDNNTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRITVSTKRSQQAVIPNIGSRPRIRGIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIESIRNGTYDHNVYRDEALNNRFQIKGVELKSGYKDWILWISFAISCFLLCVALLGFIMWACQKGNIRCNICI

SEQ ID NO: 13948 - protein, 566 aa, Artificial Sequence; identical to SEQ ID NO: 9994
  hemagglutinin__InfluenzaA__EPI404927

SEQ ID NO: 13949 - protein, 566 aa, Artificial Sequence
  hemagglutinin__InfluenzaA__EPI489319
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSACKRGSNSSFFSRLNWLTHLNFKYPALNVTMPNNEQFDKLYIWGVHHPGTDKDQIFPYAQSSGRITVSTKRSQQAVIPNIGSRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13950 - protein, 566 aa, Artificial Sequence; identical to SEQ ID NO: 12427
  hemagglutinin__InfluenzaA__EPI530647

SEQ ID NO: 13951 - protein, 566 aa, Artificial Sequence; identical to SEQ ID NO: 12441
  hemagglutinin__InfluenzaA__EPI541083

SEQ ID NO: 13952 - protein, 566 aa, Artificial Sequence
  hemagglutinin__InfluenzaA__EPI684315
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRIIVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13953 - protein, 566 aa, Artificial Sequence
  hemagglutinin__InfluenzaA__EPI614462
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTRRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13954 - protein, 566 aa, Artificial Sequence
  hemagglutinin__InfluenzaA__EPI541465
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNNSFFSRLNWLTHLNSKYPALNVTMPNNEQFDKLYIWGVHHPGTDKDQIFLYAQSSGRITVSTRRSQQAVIPNIGSRPRIRGIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13955 - protein, 566 aa, Artificial Sequence
  hemagglutinin__InfluenzaA__EPI696967
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTRLNSKYPALNVTMPNNEQFDKLYIWGVHHPETDKDQIFLYAQSSGRITVSTRRSQQAVIPNIGSRPRIRGIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13956 - protein, 566 aa, Artificial Sequence
  hemagglutinin__InfluenzaA__EPI674597
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNNSFFSRLNWLTHLNSKYPALNVTMPNNEQFDKLYIWGVHHPVTDKDQIFLYAQSSGRITVSTRRSQQAVIPNIGSRPRIRGIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13957 - protein, 566 aa, Artificial Sequence
  hemagglutinin__InfluenzaA__EPI530677
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13958 - protein, 566 aa, Artificial Sequence
  hemagglutinin__InfluenzaA__EPI530679
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNFKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13959 - protein, 566 aa, Artificial Sequence; identical to SEQ ID NO: 22
  hemagglutinin__InfluenzaA__AAG01785

SEQ ID NO: 13960 - protein, 566 aa, Artificial Sequence; identical to SEQ ID NO: 12427
  hemagglutinin__InfluenzaA__EPI814528

SEQ ID NO: 13961 - protein, 566 aa, Artificial Sequence
  hemagglutinin__InfluenzaA__EPI674736
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCRRGSNSSFFSRLNWLTHLNSKYPALNVTMPNNEQFDKLYIWGVHHPVTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13962 - protein, 566 aa, Artificial Sequence; identical to SEQ ID NO: 12427
  hemagglutinin__InfluenzaA__EPI614444

SEQ ID NO: 13963 - protein, 566 aa, Artificial Sequence
  hemagglutinin__InfluenzaA__EPI551814
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCRRGSNSSFFSRLNWLTRLNSKYPALNVTMPNNEQFDKLYIWGVHHPVTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13964 - protein, 566 aa, Artificial Sequence
  hemagglutinin__InfluenzaA__EPI696955
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCRRGSNSSFFSRLNWLTHLNSKYPALNVTMPNNEQFDKLYIWGVHHPVTDKDQIFLYAQSSGRITVSTKRSQQAVIPNIGYRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13965 - protein, 566 aa, Artificial Sequence
  hemagglutinin__InfluenzaA__EPI740790
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCRRGSNSSFFSRLNWLTHLNSKYPALNVTMPNNEQFDKLYIWGVHHPVTDKDQIFLYAQSSGRITVSTKRSQQAVIPNIGFRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13966 - protein, 566 aa, Artificial Sequence; identical to SEQ ID NO: 8709
  hemagglutinin__InfluenzaA__EPI377499

SEQ ID NO: 13967 - protein, 566 aa, Artificial Sequence
  hemagglutinin__InfluenzaA__EPI391247
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWNGVTQNGTSSACIRRSNNSFFSRLNWLTHLNFKYPALNVTMPNNEQFDKLYIWGVHHPVTDKDQIFLYAQPSGRITVSTKRSQQAVIPNIGFRPRIRNIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13968 - protein, 566 aa, Artificial Sequence
  hemagglutinin__InfluenzaA__EPI407123
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWNGVTQNGTSSACIRRSNNSFFSRLNWLTHLNFKYPALNVTMPNNEQFDKLYIWGVHHPVTDKDQIFLYAQPSGRITVSTKRSQQAVIPNIGFRPRIRNNPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGETNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13969 - protein, 566 aa, Artificial Sequence
  hemagglutinin__InfluenzaA__EPI407126
MKTIIALSYILCLVFAQKLPGNDNSTATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWNGVTQNGTSSACIRRSNNSFFSRLNWLTHLNFKYPALNVTMPNNEQFDKLYIWGVHHPVTDKDQIFLYAQPSGRITVSTKRSQQAVIPNIGFRPRIRNNPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 13970 - protein, 566 aa, Artificial Sequence; identical to SEQ ID NO: 13855
  hemagglutinin__InfluenzaA__EPI562037

SEQ ID NO: 13971 - protein, 566 aa, Artificial Sequence; identical to SEQ ID NO: 12441
  hemagglutinin__InfluenzaA__EPI562034

SEQ ID NO: 13972 - protein, 566 aa, Artificial Sequence
  hemagglutinin__InfluenzaA__EPI653140
MKTIIALSYILCLVFAQKIPGNDNSTATLCLGHHAVPNGTIVKTITNDRIEVTNATELVQNSSIGEICDSPHQILDGENCTLIDALLGDPQCDGFQNKKWDLFVERSKAYSSCYPYDVPDYASLRSLVASSGTLEFNNESFNWTGVTQNGTSSACIRRSSSSFFSRLNWLTHLNYKYPALNVTMPNNEQFDKLYIWGVHHPGTDKDQIFPYAQSSGRITVSTKRSQQAVIPNIGSRPRIRGIPSRISIYWTIVKPGDILLINSTGNLIAPRGYFKIRSGKSSIMRSDAPIGKCKSECITPNGSIPNDKPFQNVNRITYGACPRYVKHSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 13973 - protein, 568 aa, Artificial Sequence
  hemagglutinin__InfluenzaA__ACR48873/m
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIEKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13974 - protein, 568 aa, Artificial Sequence
  hemagglutinin__InfluenzaA__ACR48874/m
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPKDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 13975 - protein, 566 aa, Artificial Sequence; identical to SEQ ID NO: 9146
  hemagglutinin__InfluenzaA__ACD47234

SEQ ID NO: 13976 - protein, 568 aa, Artificial Sequence
  hemagglutinin__InfluenzaA__ACZ36881
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 13977 - protein, 567 aa, Artificial Sequence
  hemagglutinin__InfluenzaA__EPI500771
MEKIVLLFATISLVKSDHICIGYHANNSTEQVDTIMEKNVTVTHAQDILEKTHNGKLCDLNGVKPLILKDCSVAGWLLGNPLCDEFTNVPEWSYIVEKANPANDLCYPGNFNDYEELKHLLSRINHFEKIQIIPKDSWSDHEASLGVSAACSYQGNSSFFRNVVWLIKKDNAYPTIKKGYNNTNREDLLILWGIHHPNDEAEQTKLYQNPTTYISIGTSTLNQRLVPKIATRSKINRQSGRIDFFWTILKPNDAIHFESNGNFIAPEYAYKIVKKGDSTIMRSEVEYGNCNTRCQTPIGAINSSMPFHNIHPLTIGECPKYVKSNKLVLATGLRNSPQRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLKDNAKELGNGCFEFYHKCNNECMESVRNGTYDYPQYSEEARLKREEISGVKLESIGIYQILSIYSTVASSLVLAIMMAGLSLWMCSNGSLQCRICI

SEQ ID NO: 13978 - protein, 564 aa, Artificial Sequence
  hemagglutinin__InfluenzaA__ABF93441
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQIETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 13979 - protein, 568 aa, Artificial Sequence
  hemagglutinin__InfluenzaA__AGG12577
MEKIVLLFAIISLVKSDHICIGYHANNSTEQVDTIMEKNVTVTHAQDILEKTHNGKLCDLNGVKPLILKDCSVAGWLLGNPMCDEFIDVPEWSYIVEKANPANDLCYPGNFNDYEELKHLLSRINHFEKIRIIPKDSWPDHEASLGVSAACSYQGNSSFFRNVVWLLKKDNAYPIIKKSYNNTNKEDLLVLWGIHHPNDEAEQTRLYQNPTTYVSIGTSTLNQRLVPRIATRSKVNGQSGRIDFFWTILKPNDAINFESNGNFIAPEYAYKIVKKGDSTIMRSEVEYGNCSTRCQTPMGAINSSMPFHNIHPLTIGECPKYVKSNKLVLATGLRNSPQIERRRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLVLAIMVAGLSLWMCSNGSLQCRICI

SEQ ID NO: 13980 - protein, 568 aa, Artificial Sequence; identical to SEQ ID NO: 13979
  hemagglutinin__InfluenzaA__AGC13463

SEQ ID NO: 13981 - protein, 568 aa, Artificial Sequence; identical to SEQ ID NO: 5843
  hemagglutinin__InfluenzaA__ACI06178/m1

SEQ ID NO: 13982 - protein, 568 aa, Artificial Sequence
  hemagglutinin__InfluenzaA__AHF20402
MEKIVLLFAIVSLVKSDQICIGYHANNSTEQVDTIMEKNVTVTHAQDILEKTHNGKLCDLDGVRPLILRDCSVAGWLLGNPMCDEFINVPEWSYIVEKANPVNDLCYPGVFNDYEELKHLLSRINHFEKIQIIPKNSWPSHEASLGVSAACPYQGQSSFFRNVVWLIKKNNTYPTIKRSYNNTNQEDLLVMWGIHHPNDAVEQTKLYQNPTTYISVGTSTLNQRLTPRIATRSKVKGLSGRMEFFWTILKPNDAINFESNGNFIAPEYAYKIVKKGDSTIMRSELEYGNCNTKCQTPMGAINSSMPFHNIHPLTIGECPKYVKSTRLVLATGLRNSPQREERRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNKCMESVRNGTYDYPQYSEEARLKREEISGVKLESIGVYQILSIYSTVASSLALAIMVAGLSLWMCSNGSLQCRICI

SEQ ID NO: 13983 - protein, 568 aa, Artificial Sequence
  hemagglutinin__InfluenzaA__ABQ45850
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKNDAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 13984 - protein, 570 aa, Artificial Sequence
  hemagglutinin__InfluenzaA__AKI82373
MEKIVPLLAIIGLVKSDQICIGYHANNSTEQVDTIMEKNVTVTHAQDILEKTHNGKLCNLDGVKPLILKDCSVAGWLLGNPMCDEFLNVSEWSYIVEKASPANGLCYPGDFNDYEELKHLLNRITHLKKIKIIPKSYWSNHEASSGVSAACSYMGEPSFFRNVVWLIKKNNTYPPIKVNYTNTNQEDLLVLWGIHHPNNEAEQIQIYQNLITHISVGTSTLNQRLIPKIATRSKVNGQSGRMEFFWTILKPNDSINFDSNGNFIAPEYAYIVKKGDSAIMKSELEYGNCNTKCQTPMGAINSSMPFHNIHPLTIGECPKYVKSNRLVLATGLRNAPQREREGGRRRKRGLFGAIAGFIEGGWQGMVDGWYGYHHSNEQGSGYAADKESTQKAIDGITNKVNSIIDKMNTQFEAVGREFNNLERRIENLNKKMEDGFLDVWTYNAELLVLMENERTLDFHDSNVKNLYEKVRLQLRDNAKELGNGCFEFYHKCDNECMESVRNGTYDYSQYSEEARLSREEINGVKLESMVTYQILSIYSTVASSLALAIMVAGLSLWMCSNGSLQCRICI

SEQ ID NO: 13985 - protein, 570 aa, Artificial Sequence
  hemagglutinin__InfluenzaA__EPI284473
MEKIVLLLAIISLVKSDQICIGYHANNSTEQVDTIMEKNVTVTHAQDILEKTHNGKLCNLDGVKPLILKDCSVAGWLLGNPMCDEFLNVSEWSYIVEKASPANGLCYPGDFNDYEELKHLLNRITHLKKIKIIPKSYWSNHEASSGVSAACSYMGEPSFFRNVVWLIKKNNTYPPIKVNYTNTNQEDLLVLWGIHHPNNEAEQIQIYQNLITHISVGTSTLNQRLIPKIATRSKVNGQSGRMEFFWTILKPNDSINFDSNGNFIAPEYAYIVKKGDSAIMKSELEYGNCNTKCQTPMGAINSSMPFHNIHPLTIGECPKYVKSNRLVLATGLRNAPQREREGGRRRKRGLFGAIAGFIEGGWQGMVDGWYGYHHSNEQGSGYAADKESTQKAIDGITNKVNSIIDKMNTQFEAVGREFNNLERRIENLNKKMEDGFLDVWTYNAELLVLMENERTLDFHDSNVKNLYEKVRLQLRDNAKELGNGCFEFYHKCDNECMESVRNGTYDYSQYSEEARLSREEINGVKLESMVTYQILSIYSTVASSLALAIMVAGLSLWMCSNGSLQCRICI

SEQ ID NO: 13986 - protein, 569 aa, Artificial Sequence
  hemagglutinin__InfluenzaA__ACO07033
MEKIVLLLAMIGLVKSDQICIGYHANNSTEQVDTIMEKNVTVTHAQDILEKTHNGKLCNLDGVKPLILKDCSVAGWLLGNPMCDEFLNVSEWSYIVEKASPANGLCYPGDFNDYEELKHLLSRINHLKKIKIIPKSYWSNHEASSGVSAACSYLGEPSFFRNVVWLIKKNNTYPPIKVNYTNTNQEDLLVLWGIHHPNDEKEQIRIYQNPNTSISVGTSTLNQRLVPKIATRPKVNGQSGRMEFFWTILKPNDSINFDSNGNFIAPEYAYKIAKKGDSVIMKSELEYGNCNTKCQTPMGAINSSMPFHNIHPLTIGECPKYVKSNRLVLATGLRNAPQREGGRRRKRGLFGAIAGFIEGGWQGMVDGWYGYHHSNEQGSGYAADKESTQKAIDGITNKVNSIIDKMNTQFEIVGREFNNLERRIENLNKKMEDGFLDVWTYNAELLVLMENERTLDFHDSNVKNLYEKVRLQLRDNAKELGNGCFEFYHKCDNECMESVRNGTYDYPQYSEEARLSREEISGVKMESMVTYQILSIYSTVASSLALAIMVAGLSLWMCSNGSLQCRICI

SEQ ID NO: 13987 - protein, 564 aa, Artificial Sequence
  hemagglutinin__InfluenzaA__EPI174803
MEKIVLLLAMIGLVKSDQICIGYHANNSTEQVDTIMEKNVTVTHAQDILEKTHNGKLCNLDGVKPLILKDCSVAGWLLGNPMCDEFLNVSEWSYIVEKASPANGLCYPGDFNDYEELKHLLSRINHLKKIKIIPKSYWSNHEASSGVSAACSYLGEPSFFRNVVWLIKKNNTYPPIKVNYTNTNQEDLLVLWGIHHPNDEKEQIRIYQNPNTSISVGTSTLNQRLVPKIATRPKVNGQSGRMEFFWTILKPNDSINFDSNGNFIAPEYAYKIAKKGDSVIMKSELEYGNCNTKCQTPMGAINSSMPFHNIHPLTIGECPKYVKSNRLVLATGLRNAPQTETRGLFGAIAGFIEGGWQGMVDGWYGYHHSNEQGSGYAADKESTQKAIDGITNKVNSIIDKMNTQFEIVGREFNNLERRIENLNKKMEDGFLDVWTYNAELLVLMENERTLDFHDSNVKNLYEKVRLQLRDNAKELGNGCFEFYHKCDNECMESVRNGTYDYPQYSEEARLSREEISGVKMESMVTYQILSIYSTVASSLALAIMVAGLSLWMCSNGSLQCRICI

SEQ ID NO: 13988 - protein, 567 aa, Artificial Sequence
  hemagglutinin__InfluenzaA__AGZ62382
MEKIVLLFAAISLVKSDHICIGYHANNSTKQVDTIMEKNVTVTHAQDILEKTHNGKLCDLNGVKPLILKDCSVAGWLLGNPMCDEFINVPEWSYIVEKANPANGLCYPGNFNDYEELKHLLSRINHFEKIRIIPKDSWSDHEASLGVSAACPYQGNSSFFRNVVWLIKKDNTYPTIKKSYNNTNQEDLLILWGIHHPNDEAEQTRLYQNPTTYISIGTSTLNQRLVPKIATRSKINGQSGRIDFFWTILKPNDAIHFESNGNFIAPEYAYKIVKKGDSTIMKSEVEYGNCNTRCQTPIGAINSSMPFHNIHPLTIGECPKYVKSNKLVLATGLRNSPQRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVRNLYDKVRLQLKDNAKELGNGCFEFYHKCNNECMESVRNGTYDYPQYSEEARLRREEISGVKLESIGIYQILSIYSTVASSLVLAIMMAGLSLWMCSNGSLQCRICI

SEQ ID NO: 13989 - protein, 567 aa, Artificial Sequence
  hemagglutinin__InfluenzaA__ABG67978/m
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIIKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 13990 - protein, 564 aa, Artificial Sequence
  hemagglutinin__InfluenzaA__EPI827075
MEKIVLLFATISLVKSDHICIGYHANNSTEQVDTIMEKNVTVTHAQDILEKTHNGKLCDLNGVKPLILKDCSVAGWLLGNPLCDEFTNVPEWSYIVEKANPANDLCYPGNFNDYEELKHLLSRINHFEKIQIIPKDSWSDHEASLGVSAACSYQGNSSFFRNVVWLIKKDNAYPTIKKGYNNTNREDLLILWGIHHPNDEAEQTRLYQNPTTYISIGTSTLNQRLVPKIATRSKINGQSGRIDFFWTILKPNDAIHFESNGNFIAPEYAYKIVKKGDSTIMRSEVEYGNCNTRCQTPIGAINSSMPFHNIHPLTIGECPKYVKSNKLVLATGLRNSPQRETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLKDNAKELGNGCFEFYHKCNNECMESVRNGTYDYPQYSEEARLKREEISGVKLESIGIYQILSIYSTVASSLVLAIMMAGLSLWMCSNGSLQCRICI

SEQ ID NO: 13991 - protein, 568 aa, Artificial Sequence
  hemagglutinin__InfluenzaA__ABP96850
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGDFNDYEELKHLLSRINHFEKIQIIPKSSWSDYEASSGVSSACPYQGRSSFFRNVVWLIKKNNAYPTIKRSYNNTNQEDLLVLWGIHHPNDAAEQIRLYQNPTTYISVGTSTLNQRLVPKIATRSKVNGQSGRMEFFWTILKSNDAINFESNGNFIAPEYAYKIVKKGDSTIMKSELEYGNCNTKCQTPIGAINSSMPFHNIHPLTIGECPKYVKSNRLVLATGLRNSPQGERRRRKRGLFGAIAGFIEGGWQGMVDGWYGYHHSNEQGSGYAADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGIYQILSIYSTVASSLALAIMVAGLFLWMCSNGSLQCRICI

SEQ ID NO: 13992 - protein, 563 aa, Artificial Sequence
  hemagglutinin__InfluenzaA__EPI827077
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKDSWSDHEASGVSSACPYQGRSSFFRNVVWLTKKNDAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQRETRGLFGAIAGFIEGGWQGMVDGWYGYHHSNEQGSGYAADKESTQRAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 13993 - protein, 567 aa, Artificial Sequence
  hemagglutinin__InfluenzaA__EPI594523
MEKIILLLAIIGLVKSDQICVGYHANNSTERVDTIMEKNVTVTHAQDILEKTHNGKLCNLNGVKPLILEDCSVAGWLLGNPMCDKFLNVSEWSYIVEKAGPANGLCYPGDFNDYEELKHLLSRINHFEKIEIIPKNHWSNHNTSGVSSACSYLENPSFFRNVVWLTKKNNTYPTIKVNYTNANQKDLLVLWGIHHPNNEAEQKMIYQNSNTYVSVGTSTLNQRLVPKIATRSKVNGQSGRIDFFWTILKPNDTINFDSNGNFIAPKYAYKIVKKGDSAIMKSELKYDNCNTKCQTPIGAINSSMPFHNIHPLTIGECPKYVKSNRLVLATGLRNAPQIEGRRRKRGLFGAIAGFIEGGWQGMVDGWYGYHHSNEQGSGYAADKESTQKAVDGITNKINSIIDKMNNQFEAVGREFNNLERRIENLNKKMEDGFLDVWTYNAELLVLMENERTLDFHDSNVKNLYEKVRLQLRDNAKELGNGCFEFYHKCDNECMESVKNGTYDYPQYSEEARLNREEISGVKLESTVTYQILSIYSTVASSLVLAIMVAGLSLWMCSNGSLQCRICI

SEQ ID NO: 13994 - protein, 568 aa, Artificial Sequence
  hemagglutinin__InfluenzaA__AAD37782
MERIVLLLAIVSLVKSDQICIGYHANNSTEQVDTIMEKNVTVTHAQDILEKTHNGKLCDLNGVKPLILRDCSVAGWLLGNPMCDEFINVPEWSYIVEKASPANDLCYPGDFNDYEELKHLLSRTNHFEKIQIIPPSSWSNHDASSGVSSACPYHGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNTPQRERRRKKRGLFGAIAGFIEGGWQGMVNGWYGYHHSNEQGSGYAADKESTQKAIDGVTNKVNSIIDKMNTQFEAVGREFNNLERRIENLNKQMEDGFLDVWTYNAELLVLMENERTLDFHDSNVKHLYDKVRLQLRDNAKELGNGCFEFYHKCDNECMESVKNGTYDYPQYSEEARLNREEISGVKLESMGTYQILSIYSTVASSLALAIMVAGLSLWMCSNGSLQCRICI

SEQ ID NO: 13995 - protein, 568 aa, Artificial Sequence
  hemagglutinin__InfluenzaA__AAD51927
MEKIVLLLAIVSLVKSDQICIGYHANNSTEQVDTIMEKNVTVTHAQDILEKTHNGKLCDLNGVKPLILRDCSVAGWLLGNPMCDEFINVPEWSYIVEKASPANDLCYPGDFNDYEELKHLLSRTNHFEKIQIIPKSSWSNHDASSGVSSACPYHGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSGYAADKESTQKAIDGVTNKVNSIIDKMNTQFEAVGREFNNLERRIENLNKQMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQILSIYSTVASSLALAIMVAGLSLWMCSNGSLQCRICI

SEQ ID NO: 13996 - protein, 567 aa, Artificial Sequence; identical to SEQ ID NO: 7717
  hemagglutinin__InfluenzaA__AEO89181

SEQ ID NO: 13997 - protein, 568 aa, Artificial Sequence; identical to SEQ ID NO: 9171
  hemagglutinin__InfluenzaA__AFM78567

SEQ ID NO: 13998 - protein, 568 aa, Artificial Sequence
  hemagglutinin__InfluenzaA__ACR48872
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTMLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 13999 - protein, 568 aa, Artificial Sequence; identical to SEQ ID NO: 9171
  hemagglutinin__InfluenzaA__ABW06108

SEQ ID NO: 14000 - protein, 568 aa, Artificial Sequence
  hemagglutinin__InfluenzaA__EPI341633
MEKITLLLSIVSLVKSDQICIGYHANNSTEQVDTIMEKNVTVTHAQDILEKTHNGKLCDLDGVKPLILKDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKTYNNTNQEDLLILWGIHHPNNGAEQTMLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPITIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFSNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 14001 - protein, 568 aa, Artificial Sequence
  hemagglutinin__InfluenzaA__ABD95991
MEKIMLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 14002 - protein, 568 aa, Artificial Sequence
  hemagglutinin__InfluenzaA__AGN69453
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASAGVSSACPYQGMSSFFRNVVWLIKKDNAYPTIKRSYNNTNQEDLLVLWGIHHPNDAAEQTKLYQNSTTYISVGTSTLNQRLVPKIATRSKVNGQSGRIEFFWTILKPNDTINFESNGNFIAPENAYKIVKKGDSTIMKSELEYGNCNTKCQTPIGAINSSMPFHNIHPLTIGECPKYVKSSRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 14003 - protein, 568 aa, Artificial Sequence
  hemagglutinin__InfluenzaA__AGN69452
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASAGVSSACPYQGRSSFFRNVVWLIKKDNAYPTIKRSYNNTNQEDLLVLWGIHHPNDAAEQTRLYQNSTTYISVGTSTLNQRLVPKIATRSKVNGQSGRIEFFWTILKPNDTINFESNGNFIAPENAYKIVKKGDSTIMKSELEYGNCNTKCQTPIGAINSSMPFHNIHPLTIGECPKYVKSSRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 14004 - protein, 568 aa, Artificial Sequence
  hemagglutinin__InfluenzaA__ABD73284
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASAGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSSRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 14005 - protein, 564 aa, Artificial Sequence
  hemagglutinin__InfluenzaA__ABF93440
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQIETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 14006 - protein, 566 aa, Artificial Sequence
  hemagglutinin__InfluenzaA__AKC45369
MEKIVLLLAVVSLVKSDQICIGYHANNSTEQVDTIMEKNVTVTHAQDILEKTHNGRLCDLNGVKPLILKDCSVAGWLLGNPMCDEFIRVPEWSYIVERANPANDLCYPGNLNDYEELKHLLSRINHFEKTLIIPKSSWPNHTSSGVSAACPYQGTPSFFRNVVWLTKKNDAYPTIKMSYNNTNREDLLILWGIHHSNNAAEQTNLYKNPTTYVSVGTSTLNQRLVPKIATRSQVNGQRGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLRERRRKRGLFGAIAGFIEGGWQGMVDGWYGYHHSNEQGSGYAADRESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIIVAGLSLWMCSNGSLQCRICI

SEQ ID NO: 14007 - protein, 567 aa, Artificial Sequence; identical to SEQ ID NO: 12958
  hemagglutinin__InfluenzaA__AJS18479

SEQ ID NO: 14008 - protein, 567 aa, Artificial Sequence
  hemagglutinin__InfluenzaA__EPI691378
MEKIVLLLAVVSLVKSDQICIGYHANNSTEQVDTIMEKNVTVTHAQDILEKTHNGRLCDLNGVKPLILKDCSVAGWLLGNPMCDEFIRVPEWSYIVERANPANDLCYPGNLNDYEELKHLLSRINHFEKTLIIPKSSWPNHETSLGVSAACPYQGVPSFFRNVVWLTKKNDAYPTIKMSYNNTNREDLLILWGIHHSNNAAEQTNLYKNPTTYVSVGTSTLNQRLVPKIATRSQVNGQRGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLRERRRKRGLFGAIAGFIEGGWQGMVDGWYGYHHSNEQGSGYAADRESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIIVAGLSLWMCSNGSLQCRICI

SEQ ID NO: 14009 - protein, 567 aa, Artificial Sequence
  hemagglutinin__InfluenzaA__EPI533583
MEKIVLLLAIVSLVKGDQICIGYHANNSTEQVDTIMEKNVTVTHAQDILEKTHNGKLCDLNGVKPLILKDCSVAGWLLGNPMCDEFIRVPEWSYIVERANPANDLCYPGNLNDYEELKHLLSRINHFEKILIIPKSSWTNHETSLGVSAACPYQGTPSFFRNVVWLIKKNDAYPTIKISYNNTNQEDLLILWGVHHSNNAAEQTNLYKNPTTYISVGTSTLNQRLVPKIATRSQVNGQRGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNKCMESVRNGTYDYPQYSEEARLKREEISGVKLESIGTYQILSIYSTVASSLALAIIVAGLSLWMCSNGSLQCRICI

SEQ ID NO: 14010 - protein, 566 aa, Artificial Sequence; identical to SEQ ID NO: 12971
  hemagglutinin__InfluenzaA__AKS48023

SEQ ID NO: 14011 - protein, 566 aa, Artificial Sequence
  hemagglutinin__InfluenzaA__EPI587621
MEKMVLLLAAVSLVKSDQICIGYHANNSTEQVDTIMEKNVTVTHAQDILEKTHNGRLCDLNGVKPLILKDCSVAGWLLGNPMCDEFIRVPEWSYIVERANPANDLCYPGNLNDYEELKHLLSRINHFEKTLIIPKSSWPNHTSSGVSAACPYQGMPSFFRNVVWLTKKNDAYPTIKMSYNNTYREDLLILWGIHHSNNAAEQTNLYKNPTTYVSVGTSTLNQRLEPKIATRSQVNGQRGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLRERRRKRGLFGAIAGFIEGGWQGMVDGWYGYHHSNEQGSGYAADRESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIIVAGLSLWMCSNGSLQCRICI

SEQ ID NO: 14012 - protein, 567 aa, Artificial Sequence
  hemagglutinin__InfluenzaA__AJE30333
MEKIVLLLAVISLVKSDQICIGYHANNSTKQVDTIMEKNVTVTHAQDILEKTHNGKLCDLNGVKPLILKDCSVAGWLLGNPMCDEFIRVPEWSYIVERANPANDLCYPGTLNDYEELKHLLSRINHFEKTLIIPRSSWPNHETSLGVSAACPYQGASSFFRNVVWLIKKNDAYPTIKISYNNTNREDLLILWGIHHSNNAAEQTNLYKNPDTYVSVGTSTLNQRLVPKIATRSQVNGQSGRMDFFWTILKPNDAIHFESNGNFIAPEYAYKIVKKGDSTIMKSEMEYGHCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPKYSEEAILKREEISGVKLESIGTYQILSIYSTVASSLALAIIVAGLSLWMCSNGSLQCRICI

SEQ ID NO: 14013 - protein, 567 aa, Artificial Sequence
  hemagglutinin__InfluenzaA__EPI459855
MIAIVVIAILASAGKSDKICIGYHANNSTTQVDTLLEKNVTVTHSVELLENQKEKRFCKIMNKAPLDLKDCTIEGWILGNPKCDLLLGDQSWSYIVERPNAQNGICYPGVLNELEELKAFIGSGERVERFEMFPKSTWAGVDTSRGVTNACPSYTIDSSFYRNLVWIVKTDSATYPVIKGTYNNTGTQPILYFWGVHHPLDTTVQDNLYGSGDKYVRMGTESMNFAKSPEIAARPAVNGQRSRIDYYWSVLRPGETLNVESNGNLIAPWYAYKFVSTNKKGAVFKSDLPIENCDATCQTITGVLRTNKTFQNVSPLWIGECPKYVKSESLRLATGLRNVPQIATRGIFGAIAGFIEGGWTGMIDGWYGYHHENSQGSGYAADRESTQKAIDGITNKVNSIINKMNTQFEAVDHEFSNLERRIGNLNKRMEDGFLDVWTYNAELLVLLENERTLDLHDANVKNLYEKVKSQLRDNANDLGNGCFEFWHKCDNECMESVKNGTYDYPKYQKESKLNRQGIESVKLENLGVYQILAIYSTVSSSLVLVGLIMAIGLWMCSNGSMQCRICI

SEQ ID NO: 14014 - protein, 567 aa, Artificial Sequence; identical to SEQ ID NO: 14013
  hemagglutinin__InfluenzaA__EPI459855/m1

SEQ ID NO: 14015 - protein, 563 aa, Artificial Sequence
  hemagglutinin__InfluenzaA__ACZ36872
MNTQILVFALVAVIHTNADKICLGHHAVSNGTKVNTLTERGVEVVNATETVERTNIPKICSKGKRTVDLGQCGLLGTITGPPQCDQFLEFSADLIIERRDGNDVCYPGKFVNGEALRQILRKSGGINKETMGFTYSGIRTNGTTSACRRSGSSFYAEMKWLLSDTDNAAFPQMTKSYKNTRREPALIVWGIHHSGSTTEQTKLYGSGNKLVTVGSSKYQQSFVPSPGTRPQVNGQSGRIDFHWLILDSNDTVTFSFNGAFIAPDRASFLKGKSMGIQSDVQVDANCEGECYHSGGTITSSLPFQNINSRAVGKCPRYVKQESLLLATGMKNVPELPKKRRKRGLFGAIAGFIENGWEGLVDGWYGFRHQNAQGEGTAADYKSTQSAIDQITGKLNRLIEKTNQQFELIDNEFTEVEKQIGNVINWTRDSITEVWSYNAELLVAMENQHTIDLADSEMNKLYERVRKQLRENAEEDGTGCFEIFHKCDDDCMASIRNNTYDHSKYREEAMQNRIQIDPVKLSGGYKDVILWFSFGASCFLLLAIAMGLVFICVKNGNMRCTICI

SEQ ID NO: 14016 - protein, 563 aa, Artificial Sequence
  hemagglutinin__InfluenzaA__AGB51388
MNTQILVFALVAVIHTNADKICLGHHAVSNGTKVNTLTERGVEVVNATETVERTNIPKICSKGKRTVDLGQCGLLGTITGPPQCDQFLEFSADLIIERRDGNDVCYPGKFVNGEALRQILRKSGGINKETMGFTYSGIRTNGTTSACRRSGSSFYAEMKWLLSDTDNAAFPQMTKSYKNTRREPALIVWGIHHSGSTTEQTKLYGSGNKLVTVGSSKYQQSFVPNPETRPQVNGQSGRIDFHWLILDSNDTVTFSFNGAFIAPDRASFLKGKSMGIQSDVQVDANCEGECYHSGGTITSSLPFQNINSRAVGKCPRYVKQESLLLATGMKNVPELPKKRRKRGLFGAIAGFIENGWEGLVDGWYGFRHQNAQGEGTAADYKSTQSAIDQITGKLNRLIEKTNQQFELIDNEFTEVEKQTGNVINWTRDSITEVWSYNAELLVAMENQHTIDLADSEMNKLYERVRKQLRENAEEDGTGCFEIFHKCDDDCMASIRNNTYDHSKYREEAMQNRIQIDPVKLSGGYKDVILWFSFGASCFLLLAIAMGLVFICVKNGNMRCTICI

SEQ ID NO: 14017 - protein, 560 aa, Artificial Sequence; identical to SEQ ID NO: 9988
  hemagglutinin__InfluenzaA__EPI439507

SEQ ID NO: 14018 - protein, 567 aa, Artificial Sequence
  hemagglutinin__InfluenzaA__EPI164216
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 14019 - protein, 560 aa, Artificial Sequence; identical to SEQ ID NO: 12351
  hemagglutinin__InfluenzaA__EPI486492

SEQ ID NO: 14020 - protein, 560 aa, Artificial Sequence
  hemagglutinin__InfluenzaA__EPI740738
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKETMGFTYSGIRTNGVTSACKRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLILNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLIAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 14021 - protein, 560 aa, Artificial Sequence
  hemagglutinin__InfluenzaA__EPI730495
MNIQILVFALIAIIPTDADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGSKLVTVGSSNYQQSFVPSPGARPQVNGLSGRIDFHWLILNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFIEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILPAIVMGLVFMCVKNGNMRCTICI

SEQ ID NO: 14022 - protein, 560 aa, Artificial Sequence
  hemagglutinin__InfluenzaA__EPI712926
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKETMGFTYNGIRINGVTSACKRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLILNPNDTVTFSFNGAFIAPDRASFLRGKSIGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLIAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 14023 - protein, 560 aa, Artificial Sequence; identical to SEQ ID NO: 9988
  hemagglutinin__InfluenzaA__AGL44438

SEQ ID NO: 14024 - protein, 560 aa, Artificial Sequence
  hemagglutinin__InfluenzaA__EPI445996
METVSLMTILLLVTTSNADKICIGHQSTNSTETVDTLTETNVPVTHAKELLHTDHNGMLCATNLGHPLILDTCNVEGLIYGNPSCDLLLGGREWSYIVERPSAVNGTCYPGNVENLEELRTLFSSSSSYQRIQIFPDTIWNVTYTGTSKSCSDSFYRNMRWLTQKNGLYPVQDAQFTNNRGKDILFVWGIHHPPTDTAQTNLYTRTDTTTSVTTENLDRTFKPLIGPRPLVNGLIGRINYYWSVLKPGQTLRVRSNGNLIAPWYGHVLSGESHGRILKTNLNSGNCVVQCQTEKGGLNSTLPFHNISKYAFGNCPKYIGVKSLKLAIGLRNVPAKSSRGLFGAIAGFIEGGWPGLVAGWYGFQHSNDQGVGIAADRVSTQKAVDKITSKVNNIVDKMNKQYEIIDHEFSEVETRLNMINNKIDDQIQDVWAYNAELLVLLENQKTLDEHDANVNNLYNKVKRALGSNALEDGKGCFELYHKCDDQCMETIRNGTYNRRKYQEESRLERQKIEGIKLESEGTYKILTIYSTVASSLVLAMGFAAFLFWAMSNGSCRCNICI

SEQ ID NO: 14025 - protein, 564 aa, Artificial Sequence
  hemagglutinin__InfluenzaA__EPI433309
MEKIVLLLAIASLVKSDQICIGYHANNSTEQVDTIMEKNVTVTHAQDILEKTHNGKLCDLDGVKPLILRDCSVAGWLLGNPMCDKFNDVPEWSYIVEKANPANDLCYPGNLNDYEELKHLLSRINHFEKIQTFPKSSWSDHEASLGVSAACPYQGMPSFFRNVVWLIKKNNTYPTIKSSYNNTNQEDLLILWGIHHSNDEAEQTRLYQNSNTYISVGTSTLNQRLVPKIATRSKVNGQSGRMDFFWTILKPNDAINFESNGNFIAPEYAYKIVKKGDSAIMKSEVGYGDCNTKCQTPIGAINSSMPFHNIHPLTIGECPKYVKSNKLVLATGLRNSPQIETRGLFGAIAGFIEGGWQGMVDGWYGYHHSNEQGSGYAADKESTQKAIDGVTNKVNSIIDKMNTQFEAVEREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 14026 - protein, 560 aa, Artificial Sequence
  hemagglutinin__InfluenzaA__EPI470859
MEAIPLITILLVVTASNADKICIGYQSTNSTETVDTLTENNVPVTHAKELLHTEHNGMLCATNLGRPLILDTCTIEGLIYGNPSCDLLLGGREWSYIVERPSAVNGMCYPGNVENLEELRSFFSSASSYQRIQIFPDTIWNVSYSGTSKACSDSFYRSMRWLTQKNNAYPIQDAQYTNNRGKSILFMWGINHPPTDTAQTNLYTRTDTTTSVATEDINRTFKPVIGPRPLVNGLQGRIDYYWSVLKPGQTLRVRSNGNLIAPWYGHILSGESHGRILKTDLNSGSCVVQCQTERGGLNTTLPFHNVSKYAFGNCPKYVGVKSLKLAVGLRNVPARSSRGLFGAIAGFIEGGWSGLVAGWYGFQHSNDQGVGIAADRDSTQRAIDKITSKVNNIVDKMNKQYEIIDHEFSEVENRLNMINNKIDDQIQDIWAYNAELLVLLENQKTLDEHDANVNNLYNKVKRALGSNAMEDGKGCFELYHKCDDQCMETIRNGTYNRRKYKEESRLERQKIEGVKLESEGTYKILTIYSTVASSLVIAMGFAAFLFWAMSNGSCRCNICI

SEQ ID NO: 14027 - protein, 560 aa, Artificial Sequence
  hemagglutinin__InfluenzaA__EPI498037
METVSLITILLVATVSNADKICIGYQSTNSTETVDTLTENNVPVTHAKELLHTEHNGMLCATSLGQPLILDTCTIEGLIYGNPSCDLLLEGREWSYIVERPSAVNGLCYPGNVENLEELRSLFSSARSYQRIQIFPDTIWNVSYNGTSKACSGSFYRSMRWLTRKNGDYPIQDVQYTNNQGKNILFMWGINHPPTDTTQRDLYTRTDTTTSVATEEINRIFKPLIGPRPLVNGLMGRIDYYWSVLKPGQTLRIKSDGNLIAPWYGHILSGESHGRILKTDLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDNQCMETIRNGTYNKRKYQEESKLERQKIEGVKLESEGTYKILTIYSTVASSLVIAMGFAAFLFWAMSNGSCRCNICI

SEQ ID NO: 14028 - protein, 560 aa, Artificial Sequence
  hemagglutinin__InfluenzaA__AGO17847
METISLMTILLITTASNADKICIGHQSTNSTETVDTLTETNVPVTHAKELLQTEHNGMLCATNLGHPLILDTCTIEGLIYGNPSCDLLLEGREWSYIVERPSAVNGTCYPGNVENLEELRTLFSSASSYQRIQIFPDTTWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKSGNCVVQCQTEKGGLNSTLPFHNISKYAFGTCPKYVKVNSLKLAIGLRNVPARSNRGLFGAIAGFIEGGWPGLVAGWYGFQHSNDQGVGMAADRDSTQKAVDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYDRRKYREESRLERQRIEGVKLESEGTYKILTIYSTVASSLVIAMGFAAFLFWAMSNGSCRCNICI

SEQ ID NO: 14029 - protein, 560 aa, Artificial Sequence
  hemagglutinin__InfluenzaA__ANZ03807
METVSLITILLVATVSNADKICIGYQSTNSTETVDTLTENNVPVTHAKELLHTEHNGMLCATSLGQPLILDTCTIEGLIYGNPSCDLSLEGREWSYIVERPSAVNGLCYPGNVENLEELRSLFSSARSYQRIQIFPDTIWNVSYDGTSTACSGSFYRSMRWLTRKNGDYPTQDAQYTNNQGKNILFMWGINHPPTDDTQRNLYTRTDTTTSVATEEINRIFKPLIGPRPLVNGLMGRIDYYWSVLKPGQTLRIKSDGNLIAPWYGHILSGESHGRILKTDLKRGSCTVQCQTEKGGLNTTLPFQNVSKYAFGNCSKYIGIKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCNDQCMETIRNGTYNRRKYQEESKLERQKIEGVKLESEGTYKILTIYSTVASSLVIAMGFAAFLFWAMSNGSCRCNICI

SEQ ID NO: 14030 - protein, 560 aa, Artificial Sequence; identical to SEQ ID NO: 14029
  hemagglutinin__InfluenzaA__EPI680526

SEQ ID NO: 14031 - protein, 560 aa, Artificial Sequence; identical to SEQ ID NO: 13685
  hemagglutinin__InfluenzaA__ALT20080

SEQ ID NO: 14032 - protein, 469 aa, Artificial Sequence
  neuraminidase__InfluenzaA__AAA43084
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSGYVCSGLVGDTPRNDDSSSNSNCRDPNNERGNPGVKGWAFDNGDDVWMGRTINKESRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 14033 - protein, 453 aa, Artificial Sequence
  neuraminidase__InfluenzaA__AAA43397
MNPNQKIITIGSICMVVGIISLILQIGNIISIWISHSIQTGNQNHTGICNQGSITYKVVAGQDSTSVILTGNSSLCPIRGWAIHSKDNGIRIGSKGDVFVIREPFISCSHLECRTFFLTQGALLNDKHSRGTFKDRSPYRALMSCPVGEAPSPYNSRFESVAWSASACHDGVGWLTIGISGPDDGAVAVLKYNRIITETIKSWRKNILRTQESECTCVNGSCFTIMTDGPSDGLASYKIFKIEKGKVTKSIELNAPNSHYEECSCYPDTGKVMCVCRDNWHGSNRPWVSFDQNLDYKIGYICSGVFGDNPRPKDGTGSCGPVSADGANGVKGFSYKYGNGVWIGRTKSDSSRHGFEMIWDPNGWTETDSRFSMRQDVVAITNRSGYSGSFVQHPELTGLDCMRPCFWVELIRGLPEEDAIWTSGSIISFCGVNSDTVDWSWPDGAELPFTIDK

SEQ ID NO: 14034 - protein, 454 aa, Artificial Sequence
  neuraminidase__InfluenzaA__AAA43412
MNPNQKIITIGSICLVVGLISLILQIGNIISIWISHSIQTGSQNHTGICNQNIITYKNSTWVKDTTSVILTGNSSLCPIRGWAIYSKDNSIRIGSKGDVFVIREPFISCSHLECRTFFLTQGALLNDRHSNGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPKDGTGSCGPVYVDGANGVKGFSYRYGNGVWIGRTKSHSSRHGFEMIWDPNGWTETDSKFSVRQDVVAMTDWSGYSGSFVQHPELTGLDCIRPCFWVELIRGRPKEKTIWTSASSISFCGVNSDTVDWSWPDGAELPFTIDK

SEQ ID NO: 14035 - protein, 469 aa, Artificial Sequence
  neuraminidase__InfluenzaA__AAG01743
MNPNQKIITLGSVSLTIATICFLMQIAILVTTVTLHFKQYECDYPANNQAMPCEPIIIERNITEIVYLTNTTIEKEVCPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHTSPLSGSAQHVEECSCYPRYPGVRCICRDNWKGSNRPVVDINVKDYSINSSYVCSGLVGDTPRNNDRSSSSYCQNPNNEKGTHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINIMPI

SEQ ID NO: 14036 - protein, 469 aa, Artificial Sequence
  neuraminidase__InfluenzaA__AAG01759
MNPNQKIITIGSVSLTIATMCFLMQIAILVTTVTLHFKQYECNSPPNNQVILCEPTIIERNITEIVYLTNTTIEKEICPKLAEYKNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLLGSAQHVEECSCYPRYPGVRCVCRDNWKGSNRPIVDINVKDYSIVSSYVCSGLVGDTPRKNDRSSSSNCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14037 - protein, 469 aa, Artificial Sequence
  neuraminidase__InfluenzaA__AAG01777
MNPNQKIITIGSVSLTIATICFLMQIAILVTTVTLHFKQYECNSPPNNQVILCEPTIIERNITEIVYLTNTTIEKEICPKLAEYKNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLLGSAQHVEECSCYPRYPGVRCVCRDNWKGSNRPIVDINVKDYSIVSSYVCSGLVGDTPRKNDRSSSSNCLNPNNEEGGHGVKGWAFDDGNDVWMGRTISEKLRSGYETFKVIEGWSKPNSKLQINRPVIVDRGDRSGYSGIFSVEGKSCINRCFYVELIRGRKQETEVWWTSNSIVVFCGTSGTYGTGSWPDGADINLMPI

SEQ ID NO: 14038 - protein, 469 aa, Artificial Sequence
  neuraminidase__InfluenzaA__AAG01786
MNPNQKIITIGSVSLTIATMCFLMQIAILVTTVTLHFKQYECNSPPNNQVILCEPTIIERNITEIVYLTNTTIEKEICPKLAEYKNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLLGSAQHVEECSCYPRYPGVRCVCRDNWKGSNRPIVDINVKDYSIVSSYVCSGLVGDTPRKNDRSSSSNCLNPNNEEGGHGVKGWAFDDGNDVWMGRTISEKLRSGYETFKVIEGWSKPNSKLQINRQVIVDRGDRSGYSGIFSVEGKSCINRCFYVELIRGRKQETEVWWTSNSIVVFCGTSGTYGTGSWPDGADINLMPI

SEQ ID NO: 14039 - protein, 469 aa, Artificial Sequence
  neuraminidase__InfluenzaA__AAK71688
MNPNQKIITIGSVSLTIATMCFLMQIAILVTTVTLHFKQYECNSPPNNQVILCEPTIIERNITEIVYLTNATIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLLGSAQHVEECSCYPRYPGVRCVCRDNWKGSNRPIVDINVKDYSIVSSYVCSGLVGDTPRKNDRSSSSNCLNPNNEEGGHGVKGWAFDDGNDVWMGRTISEELRSGYETFKVIEGWSKPNSKLQINRQVIVDRGDRSGYSGIFSVEGKSCINRCFYVELIRGRKQETEVWWTSNSIVVFCGTSGTYGTGSWPDGADINLMPI

SEQ ID NO: 14040 - protein, 469 aa, Artificial Sequence
  neuraminidase__InfluenzaA__AAN01169
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14041 - protein, 469 aa, Artificial Sequence; identical to SEQ ID NO: 14040
  neuraminidase__InfluenzaA__AAN01170

SEQ ID NO: 14042 - protein, 469 aa, Artificial Sequence
  neuraminidase__InfluenzaA__AAN01171
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHGRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14043 - protein, 469 aa, Artificial Sequence; identical to SEQ ID NO: 14040
  neuraminidase__InfluenzaA__AAN01172

SEQ ID NO: 14044 - protein, 469 aa, Artificial Sequence
  neuraminidase__InfluenzaA__AAN01173
MNPNQKIITIGSVSLTIATICFLMQIAILVTTVTLHFKQYECNSLPNNQVMLCEPTIIERNITEIVYLTNTTIEKEMCPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14045 - protein, 469 aa, Artificial Sequence; identical to SEQ ID NO: 14040
  neuraminidase__InfluenzaA__AAN01174

SEQ ID NO: 14046 - protein, 469 aa, Artificial Sequence; identical to SEQ ID NO: 14040
  neuraminidase__InfluenzaA__AAN01175

SEQ ID NO: 14047 - protein, 469 aa, Artificial Sequence; identical to SEQ ID NO: 14040
  neuraminidase__InfluenzaA__AAN01176

SEQ ID NO: 14048 - protein, 469 aa, Artificial Sequence; identical to SEQ ID NO: 14040
  neuraminidase__InfluenzaA__AAN01177

SEQ ID NO: 14049 - protein, 469 aa, Artificial Sequence; identical to SEQ ID NO: 14040
  neuraminidase__InfluenzaA__AAN01178

SEQ ID NO: 14050 - protein, 469 aa, Artificial Sequence; identical to SEQ ID NO: 14040
  neuraminidase__InfluenzaA__AAN01179

SEQ ID NO: 14051 - protein, 469 aa, Artificial Sequence; identical to SEQ ID NO: 14040
  neuraminidase__InfluenzaA__AAN01180

SEQ ID NO: 14052 - protein, 469 aa, Artificial Sequence
  neuraminidase__InfluenzaA__AAN01181
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTIGEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14053 - protein, 469 aa, Artificial Sequence; identical to SEQ ID NO: 14040
  neuraminidase__InfluenzaA__AAN01182

SEQ ID NO: 14054 - protein, 469 aa, Artificial Sequence; identical to SEQ ID NO: 14040
  neuraminidase__InfluenzaA__AAN01183

SEQ ID NO: 14055 - protein, 469 aa, Artificial Sequence; identical to SEQ ID NO: 14040
  neuraminidase__InfluenzaA__AAN01184

SEQ ID NO: 14056 - protein, 469 aa, Artificial Sequence; identical to SEQ ID NO: 14040
  neuraminidase__InfluenzaA__AAN01185

SEQ ID NO: 14057 - protein, 469 aa, Artificial Sequence
  neuraminidase__InfluenzaA__AAN01186
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRLGYETFKVIEGWSKSNSKLQINRQVIVDRDNRSGYSGIFSVEGKSCINRCFYVELIRGRKQETEVWWTSNSIVVFCGTSGTYGTGSWPDGADINLMPI

SEQ ID NO: 14058 - protein, 469 aa, Artificial Sequence
  neuraminidase__InfluenzaA__AAN01187
MNPNQKIITIGSVSLTIATICFLMQIAILVTTVTLHFKQYECDSLPNNQVMLCEPTIIERNITEIVYLTNTTIEKEMCPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISQMSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14059 - protein, 469 aa, Artificial Sequence; identical to SEQ ID NO: 14040
  neuraminidase__InfluenzaA__AAN01188

SEQ ID NO: 14060 - protein, 469 aa, Artificial Sequence
  neuraminidase__InfluenzaA__AAN64883
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGDDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14061 - protein, 469 aa, Artificial Sequence
  neuraminidase__InfluenzaA__AAN64884
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14062 - protein, 469 aa, Artificial Sequence; identical to SEQ ID NO: 14061
  neuraminidase__InfluenzaA__AAN64885

SEQ ID NO: 14063 - protein, 469 aa, Artificial Sequence; identical to SEQ ID NO: 14061
  neuraminidase__InfluenzaA__AAN64886

SEQ ID NO: 14064 - protein, 469 aa, Artificial Sequence; identical to SEQ ID NO: 14061
  neuraminidase__InfluenzaA__AAN64887

SEQ ID NO: 14065 - protein, 469 aa, Artificial Sequence
  neuraminidase__InfluenzaA__AAN64888
MNPNQKIITIGSVSLTIATICFLMQIVILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRNQETEVLWTSNSIVVFCGTSGTYGTGSWPDGADINLMPI

SEQ ID NO: 14066 - protein, 469 aa, Artificial Sequence; identical to SEQ ID NO: 14061
  neuraminidase__InfluenzaA__AAN64889

SEQ ID NO: 14067 - protein, 469 aa, Artificial Sequence
  neuraminidase__InfluenzaA__AAN64890
MNPNQKIITIGSVSLTIATICFLMQIAILVTTVTLHFKQYECNSPPNNQEMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14068 - protein, 469 aa, Artificial Sequence; identical to SEQ ID NO: 14061
  neuraminidase__InfluenzaA__AAN64891

SEQ ID NO: 14069 - protein, 469 aa, Artificial Sequence
  neuraminidase__InfluenzaA__AAO46212
MNPNQKIITIGSVSLTIETVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDTGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 14070 - protein, 469 aa, Artificial Sequence
  neuraminidase__InfluenzaA__AAO46213
MNPNQKIITIDSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDTGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 14071 - protein, 469 aa, Artificial Sequence
  neuraminidase__InfluenzaA__AAO46214
MNPNQKIITIGSVSLTIATVCFLMQIAILATTVTLHFKQHECDSPASNQVMPCEPIIIERNITEIVYLNNTTIEKEICPEAVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGICTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRQQETRVWWTSNSIVVFCGTSGTYGTGSWPDGANINFMPI

SEQ ID NO: 14072 - protein, 469 aa, Artificial Sequence
  neuraminidase__InfluenzaA__AAO46215
MNPNQKIITIGSVSLTIATVCFLMQIAILATTVTLHFKQHECDSPTSNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNGDSSSNSNCRDPNNERGNPGVKGWAFDNGDDVWMGRTISKESRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 14073 - protein, 469 aa, Artificial Sequence
  neuraminidase__InfluenzaA__AAO46216
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPSKCYQFALGQGTTLENKHSNGTKHDRIPHRTLLMNELGVPFHLGTKQVCVAWSSSSCHDGKAWLHVCVTGDDRNATASFIYEGRLVDSIVSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDSRSGYETFKVIGGWSTPNSKSQVNRQVIVDSNNWSGYSGIFSVEGKSCINRCFYVELIRGRPQETRVWWTSNSIVVFCGTSGTYGTGSWPDGANINFMPI

SEQ ID NO: 14074 - protein, 469 aa, Artificial Sequence
  neuraminidase__InfluenzaA__AAO46217
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPSKCYQFALGQGTTLDNKHSNGTIHDRIPHRTLLMNELGVPFHLGTKQVCVAWSSSSCHDGKAWLHVCVTGDDRNATASFIYDGRLEDSIGSWSQNILRTQESECVCINGTCTVVMTDGSASGRADTRILFIKEGKIVHISPLSGSAQHIEECSCYPRYPDVRCICRDNWKGSNRPVLDISMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRSQETRVWWTSNSIVVFCGTSGTYGTGSWPDGANINFMPI

SEQ ID NO: 14075 - protein, 469 aa, Artificial Sequence
  neuraminidase__InfluenzaA__AAO46218
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLEDSIGSWSQNILRTQESECVCINGTCTVVMTDGSASGRADTRILFIKEGKIVHISPLSGSAQHIEECSCYPRYPDVRCICRDNWKGSNRPVLDISMEDYSIGSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRSQETRVWWTSNSIVVFCGTSGTYGTGSWPDGANINFMPI

SEQ ID NO: 14076 - protein, 469 aa, Artificial Sequence
  neuraminidase__InfluenzaA__AAO46220
MNPNQKIITIGSVSLTIATVCFLMQIAILATTVTLHFKQHECDSPASNQVMPCEPIIIERNITEIVYLNNTTIEKEICPEAVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDRNATASFIYDGRLVDSIGSWSQNILRTQESECVCINGICTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRQQETRVWWTSNSIVVFCGTSGTYGTGSWPDGANINFMPI

SEQ ID NO: 14077 - protein, 469 aa, Artificial Sequence
  neuraminidase__InfluenzaA__AAO46221
MNPNQKIITIGSVSLTIATVCFLMQIAILATTVTLHFKQHECDSPASNQVMPCEPIIIERNITEIVYLNNTTIEKEICPEAAEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDRNATASFIYDGRLVDSIGSWSQNILRTQESECVCINGICTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRQQETRVWWTSNSIVVFCGTSGTYGTGSWPDGANINFMPI

SEQ ID NO: 14078 - protein, 469 aa, Artificial Sequence
  neuraminidase__InfluenzaA__AAO46223
MNPNQKIITIGSVSLTIATVCFLMQIAILVTTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRDPNNERGNPGVKGWAFDNGDDVWMGRTISKDLRSGYETFKVIGGWSTPNSKSQINRQVIVDSNNWSGYSGIFSVEGKSCINRCFYVELIRGRKQETRVWWTSNSIVVFCGTSGTYGTGSWPDGANINFMPI

SEQ ID NO: 14079 - protein, 469 aa, Artificial Sequence; identical to SEQ ID NO: 14078
  neuraminidase__InfluenzaA__AAO46224

SEQ ID NO: 14080 - protein, 469 aa, Artificial Sequence
  neuraminidase__InfluenzaA__AAO46225
MNPNQKIITIGFVSLIIATVCFLMQIAILATTVTLHFKQHECDSPASNQVMPCEPIIIERNITKIVYLNNTTIEKEICPEVVEYRNWSKPQCHITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDKNATASFIYDGRLVDSIGSWSHNILRTQESECVCINGTCTVVMTDGSASGRADTRILFIKEGKIVHISPLSGSAQHVEECSCYPRYPDVRCICRDNWKGSNRPVIDINMEDYSIDSSYVCSGLVGDTPRNNDGSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRQQETRVWWTSNSIVVFCGTSGTYGTGSWPDGANINFMPI

SEQ ID NO: 14081 - protein, 469 aa, Artificial Sequence
  neuraminidase__InfluenzaA__AAO46226
MNPNQKIITIGSVSLTIATVCFLMQIAILVTTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDENATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRDPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 14082 - protein, 469 aa, Artificial Sequence
  neuraminidase__InfluenzaA__AAO46229
MNPNQKIITIGSVSLTIATVCFLMQIAILVTTVTLHFKQHECDSPASNQVMPCEPIIIERNITEIMYLNNTTIEKEICPEVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPIIDINMEDYSIDSSYVCSGLVGDTPRNDDRSSNSNCRNPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 14083 - protein, 469 aa, Artificial Sequence
  neuraminidase__InfluenzaA__AAO46230
MNPNQKIITIGSVSLTIATVCFLMQIAILVTTVTLHFKQHECDSPASNQVMPCEPIIIERNLTEIVYLNNTTIEKEICPEVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRDPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 14084 - protein, 469 aa, Artificial Sequence
  neuraminidase__InfluenzaA__AAO46231
MNPNQKIITIGSVSLTIATVCFLMQIAILVTTVTLHFKQHDCDSPASNQVMPCEPIIIERNITEIVYLNNTTIEKEICPKVVEYRNWSKPQCQITGFAPFSKDNSIRLSAGGDIWVTREPYVSCDPVKCYQFALGQGTTLDNKHSNDTVHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRNPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 14085 - protein, 469 aa, Artificial Sequence
  neuraminidase__InfluenzaA__AAO46232
MNPNQKIITIGSVSLTIATVCFLMQIAILVTTVTLHFKQHECDSPASNQVMPCEPTIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPIIDINMEDYSIDSSYVCSGLVGDTPRNDDRSSNSNCRNPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 14086 - protein, 469 aa, Artificial Sequence
  neuraminidase__InfluenzaA__AAO46233
MNPNQKIITIGSVSLTIAAVCFLMQIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVVDINMEDYSIDSSYVCSGLVGDTPRNDDRSSNSNCRNPNNERGNPGVKGWAFDNGDDVWMGRTISKDLRSGYETFKVIGGWSTPNSKSQINRQVIVDSNNRSGYSGIFSVEGKGCINRCFYVELIRGRQQETRVWWTSNSIVVFCGTSGTYGTGSWPDGANINFMPI

SEQ ID NO: 14087 - protein, 469 aa, Artificial Sequence
  neuraminidase__InfluenzaA__AAO46235
MNPNQKIITIGSVSLTIATVCFLMQIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14088 - protein, 469 aa, Artificial Sequence
  neuraminidase__InfluenzaA__AAO46236
MNPNQKIITIGSVSLTIATVCFLMHIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14089 - protein, 469 aa, Artificial Sequence
  neuraminidase__InfluenzaA__AAO46237
MNPNQKIITIGSVSLTIATVCFLMQIAILVTTVTLHFKQHECDSPASNQVMPCEPIIIERNITEIVYLNNTTIEKEICPKIVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14090 - protein, 469 aa, Artificial Sequence
  neuraminidase__InfluenzaA__AAO46238
MNPNQKIITIGSASLTIATVCFLMQIAILVTTVTLHFKQHECDSPASNQVMPCEPIIIERNITEIVYLNNTTIEKEICPKIVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVVDINMEDYSIDSSYVCSGLVGDTPRNDDRSSNSNCRNPNNEKGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINLMPI

SEQ ID NO: 14091 - protein, 469 aa, Artificial Sequence
  neuraminidase__InfluenzaA__AAO46241
MNPNQKIITIGSVSLTIATVCFLMQIAILVTTVTLHFKQHECDSPASNQVMPCEPIIIERNITEIVYLNNTTIEKEICPKVVGYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14092 - protein, 469 aa, Artificial Sequence
  neuraminidase__InfluenzaA__AAO46245
MNPNQKIITIGSVSLTIATVCFLMQIAILVTTVTLHFKQHDCDSPASNQVMPCEPIIIERNITEIVYLNNTTIEKEICPKVVEYRNWSKPQCQITGFAPFSKDNSIRLSAGGDIWVTREPYVSCDPVKCYQFALGQGTTLDNKHSNDTVHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLAGSAQHVEECSCYPRYPGVRCICRDNWKGSNRPVVDINMEDYSIDSSYVCSGLVGDTPRNDDRSSNSNCRNPNNERGTQGVKGWAFDNGNDLWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14093 - protein, 469 aa, Artificial Sequence
  neuraminidase__InfluenzaA__AAO46246
MNPNQKIITIGSVSLTIATVCFLMQIAILATTVTLHFKQHECDSPASNQVMPCEPIIIERNITEIVYLNNTIIEKEICPKVVEYRNWSKPQCQITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIAVFCGTSGTYGTGSWPDGANINFMPI

SEQ ID NO: 14094 - protein, 469 aa, Artificial Sequence
  neuraminidase__InfluenzaA__AAO46247
MNPNQKIITIGSVSLTIATVCFLMQIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVIDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14095 - protein, 469 aa, Artificial Sequence
  neuraminidase__InfluenzaA__AAO46462
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14096 - protein, 469 aa, Artificial Sequence; identical to SEQ ID NO: 14095
  neuraminidase__InfluenzaA__AAO46463

SEQ ID NO: 14097 - protein, 469 aa, Artificial Sequence; identical to SEQ ID NO: 14095
  neuraminidase__InfluenzaA__AAO46464

SEQ ID NO: 14098 - protein, 469 aa, Artificial Sequence; identical to SEQ ID NO: 14095
  neuraminidase__InfluenzaA__AAO46465

SEQ ID NO: 14099 - protein, 469 aa, Artificial Sequence; identical to SEQ ID NO: 14095
  neuraminidase__InfluenzaA__AAO46466

SEQ ID NO: 14100 - protein, 469 aa, Artificial Sequence
  neuraminidase__InfluenzaA__AAO46467
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLTGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14101 - protein, 469 aa, Artificial Sequence
  neuraminidase__InfluenzaA__AAO46468
MNPNQKIITIGSVSLTIATVCFLMQIAILVTTVTLHFKQYECDFPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14102 - protein, 469 aa, Artificial Sequence; identical to SEQ ID NO: 14095
  neuraminidase__InfluenzaA__AAO46469

SEQ ID NO: 14103 - protein, 469 aa, Artificial Sequence
  neuraminidase__InfluenzaA__AAO46471
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14104 - protein, 469 aa, Artificial Sequence
  neuraminidase__InfluenzaA__AAO46472
MNPNQKIITIGSVSLTIATVCFLMQIAILVTTVTLHFKQYECDSPASNQVMPCEPITIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVISGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 14105 - protein, 469 aa, Artificial Sequence; identical to SEQ ID NO: 14095
  neuraminidase__InfluenzaA__AAO46473

SEQ ID NO: 14106 - protein, 469 aa, Artificial Sequence; identical to SEQ ID NO: 14095
  neuraminidase__InfluenzaA__AAO46474

SEQ ID NO: 14107 - protein, 469 aa, Artificial Sequence; identical to SEQ ID NO: 14095
  neuraminidase__InfluenzaA__AAO46475

SEQ ID NO: 14108 - protein, 469 aa, Artificial Sequence
  neuraminidase__InfluenzaA__AAO46476
MNPNQKIITIGSVSLTIATVCFLMQIAILVTTVTLHFRQYECDSPANNQVMPCEPTIIERNITEIVYLNNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVEDYSIDSSYVCSGLVGDTPRNNDRSSNSNCRNPNNERGNHGVKGWAFDDGNDVWMGRTISKDLRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 14109 - protein, 469 aa, Artificial Sequence; identical to SEQ ID NO: 14095
  neuraminidase__InfluenzaA__AAO46477

SEQ ID NO: 14110 - protein, 469 aa, Artificial Sequence
  neuraminidase__InfluenzaA__AAO46478
MNPNQKIITIGSVSLIIATVCFLMQIAILVTTVTLHFKQHECDSPSSNQVMPCEPIIIERNITEIVYLNNTTIEKETCPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGNASGRADTRILFIEEGKIVHISPLSGSAQHVEECSCYPRYPDVRCICRDNWKGSNRPIVDINMKDYSIDSSYVCSGLVGDTPRNDDRSSKSNCRNPNNERGNHGVKGWAFDNGNDVWMGRTISKDLRSGYETFKVIGGWSTPNSKSQINRQVIVDSDNRSGYSGIFSVEGKSCINRCFYVELIRGREQETRVWWTSNSIVVFCGTSGTYGTGSWPDGANINFMPI

SEQ ID NO: 14111 - protein, 469 aa, Artificial Sequence
  neuraminidase__InfluenzaA__AAO46479
MNPNQKIITIGSVSLTIATVCFLMQIAILVTTVTLHFKQYECDSPASNRVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSGNRSGYSGIFSVEGKSCINRCFYVELIRGRKQETRVWWTSNSIVVFCGTSGTYGTGSWPDGANINFMPI

SEQ ID NO: 14112 - protein, 469 aa, Artificial Sequence
  neuraminidase__InfluenzaA__AAO46481
MNPNQKIITIGSVSLTIATVCFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVKDYSIDSRYVCSGLVGDTPRNNDRSSNSNCRNPNNERGNHGVKGWAFDDGNDVWMGRTISKDSRSGYETFKVIGGWSTPNSKSQINRQVIVDSDNRSGYSGIFSVESKSCINRCFYVELIRGREQETRVWWTSNSIVVFCGTSGTYGTGSWPDGADINLMPI

SEQ ID NO: 14113 - protein, 469 aa, Artificial Sequence
  neuraminidase__InfluenzaA__AAO46482
MNPNQKIITIGSVSLTIATVCFLMQIAILVTTVTLHFKQYECDSPANNQVMPCEPMIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVKDYSIDSRYVCSGLVGDTPRNNDRSSNSNCRNPNNDKGNHGVKGWAFDDGNDVWMGRTISKDSRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 14114 - protein, 469 aa, Artificial Sequence
  neuraminidase__InfluenzaA__AAO46483
MNPNQKIITIGSVSLTIATVCFLMQIAILVTTVTLHFRQYECDSPANNQVMPCEPIIIERNITEIVYLNNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVEDYSIDSSYVCSGLVGDTPRNNDRSSNSNCRNPNNERGNHGVKGWAFDDGNDVWMGRTISKDLRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 14115 - protein, 469 aa, Artificial Sequence
  neuraminidase__InfluenzaA__AAO46485
MNPNQKIITIGSVSLTIATVCFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVKDYSIDSRYVCSGLVGDTPRNNDRSSNSNCRNPNNDKGNHGVKGWAFDDGNDVWMGRTISKDSRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 14116 - protein, 469 aa, Artificial Sequence
  neuraminidase__InfluenzaA__AAO46486
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVKDYSIDSSYVCSGLVGDTPRNNDRSSNSYCRNPNNERGNHGVKGWAFDDGNDVWMGRTISKDSRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 14117 - protein, 469 aa, Artificial Sequence
  neuraminidase__InfluenzaA__AAO46489
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGKADTRILFIEEGKIVHISPLSGSAQHVEECSCYPRYPGVRCICRDNWKGSNRPVVDINVKDYSIDSSYVCSGLVGDTPRNNDRSSSSYCRNPNNERGNHGVKGWAFDDGNDVWMGRTISKDSRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 14118 - protein, 469 aa, Artificial Sequence
  neuraminidase__InfluenzaA__AAO46491
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14119 - protein, 469 aa, Artificial Sequence; identical to SEQ ID NO: 14118
  neuraminidase__InfluenzaA__AAO46492

SEQ ID NO: 14120 - protein, 469 aa, Artificial Sequence
  neuraminidase__InfluenzaA__AAO88264
MNTNQRIITIGTVCLIVGIVSLLLQIGNIVSLWISHSIQTGKKNYSKICSKSVITYENNTWVNQTYVNISNINIADGQGVNSIILAGNSSLCPISGWAIYSKDNSIRIGSKGDIFVIREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKIFKMEKGKIIKSVELDAPNYHYEECSCYPDTGKVVCVCSDNWHASNRPWVSFDQNLDYQIGYICSGVFGDNPRSNDGRGNCGPVLSNGANGVKGFSFRYGNGVWIGRTKSISSRSGFEMIWDPNGWTETDSSFSIKQDVIALTDWSGYSGSFVQHPELTGMNCIRPCFWVELIRGQPKESTIWTSGSSISFCGVDSETASWSWPDGADLPFTIDK

SEQ ID NO: 14121 - protein, 469 aa, Artificial Sequence
  neuraminidase__InfluenzaA__AAQ10334
MNPNQKIITIGSVSLTIATICFLMQIAILVTTVTLHFKQYECNPPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYNGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14122 - protein, 469 aa, Artificial Sequence; identical to SEQ ID NO: 14121
  neuraminidase__InfluenzaA__AAQ10335

SEQ ID NO: 14123 - protein, 469 aa, Artificial Sequence
  neuraminidase__InfluenzaA__AAQ10336
MNPNQKIITIGSVSLTIATICFLMQIAILVTTVTLHFKQYECNPPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYNGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGAEINLMPI

SEQ ID NO: 14124 - protein, 469 aa, Artificial Sequence; identical to SEQ ID NO: 14121
  neuraminidase__InfluenzaA__AAQ10337

SEQ ID NO: 14125 - protein, 469 aa, Artificial Sequence
  neuraminidase__InfluenzaA__AAQ10339
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISETLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14126 - protein, 469 aa, Artificial Sequence
  neuraminidase__InfluenzaA__AAQ10341
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14127 - protein, 469 aa, Artificial Sequence
  neuraminidase__InfluenzaA__AAQ10343
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVAFCGTSGTYGTGSWPDGADINLMPI

SEQ ID NO: 14128 - protein, 396 aa, Artificial Sequence
  neuraminidase__InfluenzaA__AAQ10344
MNPNQKIITIGSVSLTIATICFLMQIAILVTTVTLHFKQYECNSPPNNQAMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHTSKLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINSKS

SEQ ID NO: 14129 - protein, 471 aa, Artificial Sequence
  neuraminidase__InfluenzaA__AAR11366
MNPNQKLFALSGVAIALSVLNLLIGISNVGLNVSLHLKEKGPKQEENLTCTTINQNNTTVVENTYVNNTTIITKGTDLKTPSYLLLNKSLCNVEGWVVIAKDNAVRFGESEQIIVTREPYVSCDPTGCKMYALHQGTTIRNKHSNGTIHDRTAFRGLISTPLGTPPTVSNSDFMCVGWSSTTCHDGIARMTICIQGNNDNATATVYYNRRLTTTIKTWARNILRTQESECVCHNGTCAVVMTDGSASSQAYTKVMYFHKGLVVKEEELRGSARHIEECSCYGHNQKVTCVCRDNWQGANRPIIEIDMNTLEHTSRYVCTGILTDTSRPGDKSSGDCSNPITGSPGAPGVKGFGFLNGDNTWLGRTISPRSRSGFEMLKIPNAGTDPNSRIAERQEIVDNNNWSGYSGSFIDYWNDNSECYNPCFYVELIRGRPEEAKYVWWTSNSLIALCGSPFPVGPGSFPDGAQIQYFS

SEQ ID NO: 14130 - protein, 449 aa, Artificial Sequence
  neuraminidase__InfluenzaA__AAS89005
MNPNKKIITIGSICMVTGMVSLMLQIGNLISIWVSHSIHTGNQQKAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDSGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWIETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 14131 - protein, 449 aa, Artificial Sequence
  neuraminidase__InfluenzaA__AAS89006
MNPNKKIITIGSICMVTGMVSLMLQIGNLISIWVSHSIHTGNQHKAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 14132 - protein, 469 aa, Artificial Sequence
  neuraminidase__InfluenzaA__AAT38822
MNPNQKIITIGVVNTTLSTIALFIGVGNLVFNTVIHEKIGDHQIVTHPTIMTPEVPNCSDTIITYNNTVINNITTTIITEAERPFKSPLPLCPFRGFFPFHKDNAIRLGENKDVIVTREPYVSCDNDNCWSFALAQGALLGTKHSNGTIKDRTPYRSLIRFPIGTAPVLGNYKEICIAWSSSSCFDGKEWMHVCMTGNDNDASAQIIYGGRMTDSIKSWRKDILRTQESECQCIDGTCVVAVTDGPAANSADHRVYWIREGRIIKYENVPKTKIQHLEECSCYVDIDVYCICRDNWKGSNRPWMRINNETILETGYVCSKFHSDTPRPADPSIMSCDSPSNVNGGPGVKGFGFKAGNDVWLGRTVSTSGRSGFEIIKVTEGWINSPNHVKSITQTLVSNNDWSGYSGSFIVKAKDCFQPCFYVELIRGRPNKNDDVSWTSNSIVTFCGLDNEPGSGNWPDGSNIGFMPK

SEQ ID NO: 14133 - protein, 449 aa, Artificial Sequence; identical to SEQ ID NO: 14131
  neuraminidase__InfluenzaA__AAV65827

SEQ ID NO: 14134 - protein, 469 aa, Artificial Sequence
  neuraminidase__InfluenzaA__AAX11488
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISALSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14135 - protein, 469 aa, Artificial Sequence
  neuraminidase__InfluenzaA__AAX11508
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNNTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14136 - protein, 469 aa, Artificial Sequence
  neuraminidase__InfluenzaA__AAX11538
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHERTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14137 - protein, 469 aa, Artificial Sequence
  neuraminidase__InfluenzaA__AAX11548
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14138 - protein, 469 aa, Artificial Sequence; identical to SEQ ID NO: 14135
  neuraminidase__InfluenzaA__AAX11558

SEQ ID NO: 14139 - protein, 469 aa, Artificial Sequence
  neuraminidase__InfluenzaA__AAX11568
MNPNQKIITIGSVSLTIATICFLMQIAILVTTVTLHFKQHECYSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14140 - protein, 469 aa, Artificial Sequence; identical to SEQ ID NO: 14135
  neuraminidase__InfluenzaA__AAX11578

SEQ ID NO: 14141 - protein, 469 aa, Artificial Sequence
  neuraminidase__InfluenzaA__AAX11588
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECICINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEKTEVWWTSNSIVVFCGTSGTYGTGSWPDGADINLMPI

SEQ ID NO: 14142 - protein, 469 aa, Artificial Sequence; identical to SEQ ID NO: 14137
  neuraminidase__InfluenzaA__AAX11598

SEQ ID NO: 14143 - protein, 469 aa, Artificial Sequence; identical to SEQ ID NO: 14137
  neuraminidase__InfluenzaA__AAX11608

SEQ ID NO: 14144 - protein, 469 aa, Artificial Sequence
  neuraminidase__InfluenzaA__AAX11618
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISALSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14145 - protein, 469 aa, Artificial Sequence
  neuraminidase__InfluenzaA__AAX12744
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14146 - protein, 469 aa, Artificial Sequence; identical to SEQ ID NO: 14137
  neuraminidase__InfluenzaA__AAX12754

SEQ ID NO: 14147 - protein, 469 aa, Artificial Sequence
  neuraminidase__InfluenzaA__AAX12774
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14148 - protein, 469 aa, Artificial Sequence
  neuraminidase__InfluenzaA__AAX12804
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDNFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14149 - protein, 469 aa, Artificial Sequence
  neuraminidase__InfluenzaA__AAX12814
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14150 - protein, 469 aa, Artificial Sequence
  neuraminidase__InfluenzaA__AAX34064
MNPNQKIITIGSVSLTIATICFLMQIAILVTTVTLHFKQHECNSPPNNQVMLCEPTIIERNITEIVYLTNTTIEREICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14151 - protein, 469 aa, Artificial Sequence
  neuraminidase__InfluenzaA__AAX35824
MNPNQKIITIGSVSLTIATICFLMQIAILVTTVTLHFKQYECNSPPNNQVMLCEPTIIERNITEIVYLANTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14152 - protein, 469 aa, Artificial Sequence; identical to SEQ ID NO: 14135
  neuraminidase__InfluenzaA__AAX35834

SEQ ID NO: 14153 - protein, 469 aa, Artificial Sequence
  neuraminidase__InfluenzaA__AAX35844
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSNSHCLDPNNEEGGHGVKGWAFDDGNDVWMGRTISEKLRSGYETFKVIEGWFKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14154 - protein, 469 aa, Artificial Sequence
  neuraminidase__InfluenzaA__AAX35854
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14155 - protein, 469 aa, Artificial Sequence
  neuraminidase__InfluenzaA__AAX35864
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKNILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14156 - protein, 469 aa, Artificial Sequence
  neuraminidase__InfluenzaA__AAX47538
MNPNQKIITIGSVSLTIATICFLMQIAILVTTVTLHFKQYECNSPPNNQVMLCEPAIIERNITEIVYLTNTTIEEEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14157 - protein, 469 aa, Artificial Sequence; identical to SEQ ID NO: 14135
  neuraminidase__InfluenzaA__AAX56383

SEQ ID NO: 14158 - protein, 469 aa, Artificial Sequence
  neuraminidase__InfluenzaA__AAX56393
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGKGTTLNNGHSNNTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14159 - protein, 469 aa, Artificial Sequence; identical to SEQ ID NO: 14135
  neuraminidase__InfluenzaA__AAX56413

SEQ ID NO: 14160 - protein, 469 aa, Artificial Sequence; identical to SEQ ID NO: 14137
  neuraminidase__InfluenzaA__AAX56423

SEQ ID NO: 14161 - protein, 469 aa, Artificial Sequence; identical to SEQ ID NO: 14135
  neuraminidase__InfluenzaA__AAX56433

SEQ ID NO: 14162 - protein, 469 aa, Artificial Sequence; identical to SEQ ID NO: 14154
  neuraminidase__InfluenzaA__AAX56443

SEQ ID NO: 14163 - protein, 469 aa, Artificial Sequence
  neuraminidase__InfluenzaA__AAX56473
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKNCINRCFYVELIRGRKEETEVWWTSNSIVVFCGTSGTYGTGSWPDGADINLMPI

SEQ ID NO: 14164 - protein, 469 aa, Artificial Sequence
  neuraminidase__InfluenzaA__AAX56483
MNPNQKIITIGSVSLTIATICFLMQIAILVTTVTLHFKQYECDSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14165 - protein, 469 aa, Artificial Sequence; identical to SEQ ID NO: 14164
  neuraminidase__InfluenzaA__AAX56503

SEQ ID NO: 14166 - protein, 469 aa, Artificial Sequence
  neuraminidase__InfluenzaA__AAX56513
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14167 - protein, 470 aa, Artificial Sequence
  neuraminidase__InfluenzaA__AAX56533
MNPNQKIITIGSISVAIGIISLILQIGNIISIWASHSIQTGSQNYTGICNQRIITYENRTWVNQTYVNINNTNVVAGKDKTSMTLAGNSSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMNDWSGYSGSFVQHPELTGLDCMRPCFWVELVRGLPRENTTIWTSGSSISFCGVNSETANWSWPDGAELPFTIDK

SEQ ID NO: 14168 - protein, 469 aa, Artificial Sequence
  neuraminidase__InfluenzaA__AAX56543
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSASGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEELRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14169 - protein, 469 aa, Artificial Sequence; identical to SEQ ID NO: 14061
  neuraminidase__InfluenzaA__AAX56553

SEQ ID NO: 14170 - protein, 469 aa, Artificial Sequence
  neuraminidase__InfluenzaA__AAX56563
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISALSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERDNRSGYSGIFSVEGKSCINRCFYVELIRGRKEETEVWWTSNSIVVFCGTSGTYGTGSWPDGADINLMPI

SEQ ID NO: 14171 - protein, 469 aa, Artificial Sequence
  neuraminidase__InfluenzaA__AAX56573
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14172 - protein, 469 aa, Artificial Sequence
  neuraminidase__InfluenzaA__AAX56583
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDHWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14173 - protein, 469 aa, Artificial Sequence
  neuraminidase__InfluenzaA__AAX56593
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKFRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14174 - protein, 469 aa, Artificial Sequence
  neuraminidase__InfluenzaA__AAX56603
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTAHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14175 - protein, 469 aa, Artificial Sequence; identical to SEQ ID NO: 14145
  neuraminidase__InfluenzaA__AAX57647

SEQ ID NO: 14176 - protein, 469 aa, Artificial Sequence; identical to SEQ ID NO: 14135
  neuraminidase__InfluenzaA__AAX57657

SEQ ID NO: 14177 - protein, 469 aa, Artificial Sequence; identical to SEQ ID NO: 14173
  neuraminidase__InfluenzaA__AAX57667

SEQ ID NO: 14178 - protein, 469 aa, Artificial Sequence; identical to SEQ ID NO: 14154
  neuraminidase__InfluenzaA__AAX57677

SEQ ID NO: 14179 - protein, 469 aa, Artificial Sequence
  neuraminidase__InfluenzaA__AAX57687
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYDGRLVDSIGSWSKKILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14180 - protein, 469 aa, Artificial Sequence
  neuraminidase__InfluenzaA__AAX57697
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDHSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14181 - protein, 469 aa, Artificial Sequence
  neuraminidase__InfluenzaA__AAX57707
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDRFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14182 - protein, 469 aa, Artificial Sequence; identical to SEQ ID NO: 14154
  neuraminidase__InfluenzaA__AAX57717

SEQ ID NO: 14183 - protein, 469 aa, Artificial Sequence; identical to SEQ ID NO: 14173
  neuraminidase__InfluenzaA__AAX57726

SEQ ID NO: 14184 - protein, 469 aa, Artificial Sequence; identical to SEQ ID NO: 14173
  neuraminidase__InfluenzaA__AAX57737

SEQ ID NO: 14185 - protein, 469 aa, Artificial Sequence; identical to SEQ ID NO: 14061
  neuraminidase__InfluenzaA__AAX57747

SEQ ID NO: 14186 - protein, 469 aa, Artificial Sequence; identical to SEQ ID NO: 14061
  neuraminidase__InfluenzaA__AAX57757

SEQ ID NO: 14187 - protein, 469 aa, Artificial Sequence
  neuraminidase__InfluenzaA__AAX57767
MNPNQKIITIGSVSLTIATICFLMQIAILVTTVTLHFKQYECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14188 - protein, 469 aa, Artificial Sequence
  neuraminidase__InfluenzaA__AAX57777
MNPNQKIITIGSVSLIIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14189 - protein, 469 aa, Artificial Sequence
  neuraminidase__InfluenzaA__AAX57787
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKANTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKFRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14190 - protein, 469 aa, Artificial Sequence; identical to SEQ ID NO: 14061
  neuraminidase__InfluenzaA__AAX57797

SEQ ID NO: 14191 - protein, 469 aa, Artificial Sequence; identical to SEQ ID NO: 14061
  neuraminidase__InfluenzaA__AAX57807

SEQ ID NO: 14192 - protein, 469 aa, Artificial Sequence
  neuraminidase__InfluenzaA__AAX57817
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSISSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14193 - protein, 469 aa, Artificial Sequence; identical to SEQ ID NO: 14061
  neuraminidase__InfluenzaA__AAX57837

SEQ ID NO: 14194 - protein, 469 aa, Artificial Sequence
  neuraminidase__InfluenzaA__AAX57847
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 14195 - protein, 469 aa, Artificial Sequence
  neuraminidase__InfluenzaA__AAX57857
MNPNQKIITIGSVSLTIATICFLMQIAILVTTVTLHFKQYECNSPPNNQVMLCEPTTIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14196 - protein, 469 aa, Artificial Sequence; identical to SEQ ID NO: 14061
  neuraminidase__InfluenzaA__AAX57867

SEQ ID NO: 14197 - protein, 469 aa, Artificial Sequence
  neuraminidase__InfluenzaA__AAX57877
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMHI

SEQ ID NO: 14198 - protein, 469 aa, Artificial Sequence; identical to SEQ ID NO: 14061
  neuraminidase__InfluenzaA__AAX57887

SEQ ID NO: 14199 - protein, 469 aa, Artificial Sequence
  neuraminidase__InfluenzaA__AAX57897
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDSGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14200 - protein, 469 aa, Artificial Sequence
  neuraminidase__InfluenzaA__AAX57907
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQMNRQVIVDRGNRSGYSGIFSVEGKSCINRCFYVELIRGRKQETEVLWTSNSIVVFCGTSGTYGTGSWPDGADINLMPI

SEQ ID NO: 14201 - protein, 469 aa, Artificial Sequence; identical to SEQ ID NO: 14061
  neuraminidase__InfluenzaA__AAX57917

SEQ ID NO: 14202 - protein, 469 aa, Artificial Sequence; identical to SEQ ID NO: 14061
  neuraminidase__InfluenzaA__AAX57927

SEQ ID NO: 14203 - protein, 469 aa, Artificial Sequence
  neuraminidase__InfluenzaA__AAX57937
MNPNQKIITIGSVSLTIATICFLMQIAILVTTVTLHFKQYECNSPPNNQVMLCEPTIIERNITEMVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMRI

SEQ ID NO: 14204 - protein, 469 aa, Artificial Sequence
  neuraminidase__InfluenzaA__AAX57947
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSRKILRTQESECVCINGTCTVVMTDGSASGKADTKILFIEEGKIVHISTLSGSAQHVEECSCYPRYPGVRCVCRDNWKGSNRPIVDINVKDYSIASSYMCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14205 - protein, 469 aa, Artificial Sequence; identical to SEQ ID NO: 14145
  neuraminidase__InfluenzaA__AAX76626

SEQ ID NO: 14206 - protein, 469 aa, Artificial Sequence
  neuraminidase__InfluenzaA__AAX76646
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNNTVHDRTPYRTLLMNELGVPFHLGTRQVCIAWSSSGCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14207 - protein, 469 aa, Artificial Sequence; identical to SEQ ID NO: 14135
  neuraminidase__InfluenzaA__AAX76656

SEQ ID NO: 14208 - protein, 469 aa, Artificial Sequence; identical to SEQ ID NO: 14180
  neuraminidase__InfluenzaA__AAX76666

SEQ ID NO: 14209 - protein, 469 aa, Artificial Sequence; identical to SEQ ID NO: 14061
  neuraminidase__InfluenzaA__AAX76696

SEQ ID NO: 14210 - protein, 469 aa, Artificial Sequence
  neuraminidase__InfluenzaA__AAX76736
MNPNQKIITIGSVSLTIATICFLMQIAILVTTVTLHFKQYECNSPPNNQVMLCEPTIIERNITEIVYLTNTTIEKEICPKLSEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHISTLSRSAQHVEECSCYPRYPGVRCVCRDNWKGSNRPIVDINVKDHSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14211 - protein, 469 aa, Artificial Sequence
  neuraminidase__InfluenzaA__AAX76766
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSVGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14212 - protein, 469 aa, Artificial Sequence; identical to SEQ ID NO: 14137
  neuraminidase__InfluenzaA__AAY18089

SEQ ID NO: 14213 - protein, 469 aa, Artificial Sequence
  neuraminidase__InfluenzaA__AAY18099
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNNTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFVEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14214 - protein, 469 aa, Artificial Sequence
  neuraminidase__InfluenzaA__AAY18109
MNPNQKIITIGSVSLTIATICFLMQIAILVTTLTLHFKQYECNSPPNNQVMLCEPAIIERNITEIVYLTNTTIEKEKCPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14215 - protein, 469 aa, Artificial Sequence; identical to SEQ ID NO: 14173
  neuraminidase__InfluenzaA__AAY18119

SEQ ID NO: 14216 - protein, 469 aa, Artificial Sequence
  neuraminidase__InfluenzaA__AAY18129
MNPNQKIITIGSVSLTIATICFLMQITILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKSNSKLQINRQVIVERGNRSGYSGIFSVEGKSCINRCFYVELIRGRKEETEVWWTSNSIVVFCGTSGTYGTGSWPDGADINLMPI

SEQ ID NO: 14217 - protein, 469 aa, Artificial Sequence
  neuraminidase__InfluenzaA__AAY18139
MNPNQKIITIGSVSLTIATICFLMQIAILVTTVTLHFKQHECNSPPNNQVMLCEPTIIERNITEIVYLTNTTIEREICPKLAEYRNWSKPQCNITGFAPFSKDNSIRLSAGGDIWVTREPYVSCDPDKCYQFALGQGTTLNNRHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14218 - protein, 469 aa, Artificial Sequence
  neuraminidase__InfluenzaA__AAY18149
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPTVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14219 - protein, 469 aa, Artificial Sequence
  neuraminidase__InfluenzaA__AAY18159
MNPNQKIITIGSVSLIIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKNCINRCFYVELIRGRKQETEVLWTSNSIVVFCGTSGTYGTGSWPDGADINLMPI

SEQ ID NO: 14220 - protein, 469 aa, Artificial Sequence; identical to SEQ ID NO: 14061
  neuraminidase__InfluenzaA__AAY18179

SEQ ID NO: 14221 - protein, 469 aa, Artificial Sequence; identical to SEQ ID NO: 14061
  neuraminidase__InfluenzaA__AAY18189

SEQ ID NO: 14222 - protein, 469 aa, Artificial Sequence
  neuraminidase__InfluenzaA__AAY18199
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGQGVKGWAFDDGNDVWMGRTISEKLHSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14223 - protein, 469 aa, Artificial Sequence; identical to SEQ ID NO: 14164
  neuraminidase__InfluenzaA__AAY18588

SEQ ID NO: 14224 - protein, 469 aa, Artificial Sequence; identical to SEQ ID NO: 14145
  neuraminidase__InfluenzaA__AAY18614

SEQ ID NO: 14225 - protein, 469 aa, Artificial Sequence
  neuraminidase__InfluenzaA__AAY27846
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14226 - protein, 469 aa, Artificial Sequence
  neuraminidase__InfluenzaA__AAY27856
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPGKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14227 - protein, 469 aa, Artificial Sequence; identical to SEQ ID NO: 14137
  neuraminidase__InfluenzaA__AAY27866

SEQ ID NO: 14228 - protein, 469 aa, Artificial Sequence
  neuraminidase__InfluenzaA__AAY27962
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNNVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14229 - protein, 469 aa, Artificial Sequence
  neuraminidase__InfluenzaA__AAY27997
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNNTVHDRTPYRTLLMNEMGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14230 - protein, 469 aa, Artificial Sequence; identical to SEQ ID NO: 14135
  neuraminidase__InfluenzaA__AAY28007

SEQ ID NO: 14231 - protein, 469 aa, Artificial Sequence; identical to SEQ ID NO: 14180
  neuraminidase__InfluenzaA__AAY28017

SEQ ID NO: 14232 - protein, 469 aa, Artificial Sequence; identical to SEQ ID NO: 14135
  neuraminidase__InfluenzaA__AAY28268

SEQ ID NO: 14233 - protein, 469 aa, Artificial Sequence
  neuraminidase__InfluenzaA__AAY28278
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHTSKLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVERGNRSGYSGIFSVEGKSCINRCFYVELIRGRKPETEVWWTSNSIVVFCGTSGTYGTGSWPDGADINLMPI

SEQ ID NO: 14234 - protein, 469 aa, Artificial Sequence; identical to SEQ ID NO: 14149
  neuraminidase__InfluenzaA__AAY28288

SEQ ID NO: 14235 - protein, 469 aa, Artificial Sequence
  neuraminidase__InfluenzaA__AAY28298
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSRPNSKLQINRQVIVERGNRSGYSGIFSVEGKSCINRCFYVELIRGRKEETEVWWTSNSIVVFCGTSGTYGTGSWPDGADINLMPI

SEQ ID NO: 14236 - protein, 469 aa, Artificial Sequence; identical to SEQ ID NO: 14166
  neuraminidase__InfluenzaA__AAY28308

SEQ ID NO: 14237 - protein, 469 aa, Artificial Sequence
  neuraminidase__InfluenzaA__AAY28318
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCAVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14238 - protein, 469 aa, Artificial Sequence
  neuraminidase__InfluenzaA__AAY28338
MNPNQKIITIGSVSLTIATICFLMQIAILVTTVTLHFKQYECNSPPNNQVMLCEPAIIERNITEIVYLTNTTIEKEIRPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14239 - protein, 469 aa, Artificial Sequence; identical to SEQ ID NO: 14145
  neuraminidase__InfluenzaA__AAY28348

SEQ ID NO: 14240 - protein, 469 aa, Artificial Sequence; identical to SEQ ID NO: 14061
  neuraminidase__InfluenzaA__AAY28358

SEQ ID NO: 14241 - protein, 469 aa, Artificial Sequence; identical to SEQ ID NO: 14145
  neuraminidase__InfluenzaA__AAY28388

SEQ ID NO: 14242 - protein, 469 aa, Artificial Sequence; identical to SEQ ID NO: 14150
  neuraminidase__InfluenzaA__AAY28398

SEQ ID NO: 14243 - protein, 469 aa, Artificial Sequence; identical to SEQ ID NO: 14164
  neuraminidase__InfluenzaA__AAY28408

SEQ ID NO: 14244 - protein, 469 aa, Artificial Sequence; identical to SEQ ID NO: 14137
  neuraminidase__InfluenzaA__AAY28505

SEQ ID NO: 14245 - protein, 469 aa, Artificial Sequence
  neuraminidase__InfluenzaA__AAY28524
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNYTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14246 - protein, 469 aa, Artificial Sequence; identical to SEQ ID NO: 14135
  neuraminidase__InfluenzaA__AAY28534

SEQ ID NO: 14247 - protein, 469 aa, Artificial Sequence
  neuraminidase__InfluenzaA__AAY28544
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPNKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14248 - protein, 469 aa, Artificial Sequence; identical to SEQ ID NO: 14061
  neuraminidase__InfluenzaA__AAY28554

SEQ ID NO: 14249 - protein, 469 aa, Artificial Sequence
  neuraminidase__InfluenzaA__AAY28564
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSRPNSKLQINRQVIVERGNRSGYSGIFSVESKSCINRCFYVELIRGRKEETEVWWTSNSIVVFCGTSGTYGTGSWPDGADINLMPI

SEQ ID NO: 14250 - protein, 469 aa, Artificial Sequence; identical to SEQ ID NO: 14135
  neuraminidase__InfluenzaA__AAY28574

SEQ ID NO: 14251 - protein, 469 aa, Artificial Sequence; identical to SEQ ID NO: 14149
  neuraminidase__InfluenzaA__AAY28584

SEQ ID NO: 14252 - protein, 469 aa, Artificial Sequence; identical to SEQ ID NO: 14061
  neuraminidase__InfluenzaA__AAY28594

SEQ ID NO: 14253 - protein, 469 aa, Artificial Sequence
  neuraminidase__InfluenzaA__AAY28611
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14254 - protein, 469 aa, Artificial Sequence; identical to SEQ ID NO: 14166
  neuraminidase__InfluenzaA__AAY28651

SEQ ID NO: 14255 - protein, 469 aa, Artificial Sequence
  neuraminidase__InfluenzaA__AAY44613
MNPNQKIITIGSVSLTIATICFLMQIAILVTTVTLHFKQHECNSPPNNQVMLCEPTIIERNITEIVYLTNTTIEKEICPKIAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14256 - protein, 469 aa, Artificial Sequence; identical to SEQ ID NO: 14149
  neuraminidase__InfluenzaA__AAY44624

SEQ ID NO: 14257 - protein, 469 aa, Artificial Sequence; identical to SEQ ID NO: 14171
  neuraminidase__InfluenzaA__AAY44634

SEQ ID NO: 14258 - protein, 469 aa, Artificial Sequence; identical to SEQ ID NO: 14164
  neuraminidase__InfluenzaA__AAY44644

SEQ ID NO: 14259 - protein, 469 aa, Artificial Sequence
  neuraminidase__InfluenzaA__AAY44654
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQIHRQVIVDRGNRSGYSGIFSVEGKSCINRCFYVELIRGRKQETEVLWTSNSIVVFCGTSGTYGTGSWPDGADINLMPI

SEQ ID NO: 14260 - protein, 469 aa, Artificial Sequence
  neuraminidase__InfluenzaA__AAY44758
MNPNQKIITIGSVSLTIATICFLMQIAILVTTVTLHFKQYECNSPSNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHTSKLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVERGNRSGYSGIFSVEGKSCINRCFYVELIRGRKPETEVWWTSNSIVVFCGTSGTYGTGSWPDGADINLMPI

SEQ ID NO: 14261 - protein, 469 aa, Artificial Sequence; identical to SEQ ID NO: 14061
  neuraminidase__InfluenzaA__AAY44778

SEQ ID NO: 14262 - protein, 469 aa, Artificial Sequence
  neuraminidase__InfluenzaA__AAY44788
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYEIFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14263 - protein, 469 aa, Artificial Sequence; identical to SEQ ID NO: 14137
  neuraminidase__InfluenzaA__AAY44909

SEQ ID NO: 14264 - protein, 469 aa, Artificial Sequence; identical to SEQ ID NO: 14164
  neuraminidase__InfluenzaA__AAY45649

SEQ ID NO: 14265 - protein, 469 aa, Artificial Sequence
  neuraminidase__InfluenzaA__AAY46374
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPYKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHTSKLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVERGNMSGYSGIFSVEGKSCINRCFYVELIRGRKQETEVWWTSNSIVVFCGTSGTYGTGSWPDGADINLMPI

SEQ ID NO: 14266 - protein, 469 aa, Artificial Sequence
  neuraminidase__InfluenzaA__AAY46384
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDAVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14267 - protein, 469 aa, Artificial Sequence
  neuraminidase__InfluenzaA__AAY46394
MNPNQKIITIGSVSLTIATICFLMQIAILITTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADIDLMPI

SEQ ID NO: 14268 - protein, 469 aa, Artificial Sequence
  neuraminidase__InfluenzaA__AAY46419
MNPNQKIITIGSVSLTIATICFLMQIAILVTTVTLHFKQYECNSLPNNQVMLCEPTILERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHNENATASFIYGGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14269 - protein, 469 aa, Artificial Sequence
  neuraminidase__InfluenzaA__AAY47016
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGNAQHVEECSCYPRYPGVRCVCRDNWKGSNRPIVDINVKDYSIVSSYVCSGLVGDTPRKNDSFSSSHCLDPNSEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14270 - protein, 469 aa, Artificial Sequence
  neuraminidase__InfluenzaA__AAY47055
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLFPI

SEQ ID NO: 14271 - protein, 469 aa, Artificial Sequence
  neuraminidase__InfluenzaA__AAY47078
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDHDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14272 - protein, 469 aa, Artificial Sequence
  neuraminidase__InfluenzaA__AAY47088
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14273 - protein, 469 aa, Artificial Sequence; identical to SEQ ID NO: 14137
  neuraminidase__InfluenzaA__AAY58319

SEQ ID NO: 14274 - protein, 463 aa, Artificial Sequence
  neuraminidase__InfluenzaA__AAY59038
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14275 - protein, 469 aa, Artificial Sequence
  neuraminidase__InfluenzaA__AAY64195
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQEAEVWWTSNSIVVFCGTSGTYGTGSWPDGADINLMPI

SEQ ID NO: 14276 - protein, 469 aa, Artificial Sequence; identical to SEQ ID NO: 14135
  neuraminidase__InfluenzaA__AAY64205

SEQ ID NO: 14277 - protein, 469 aa, Artificial Sequence; identical to SEQ ID NO: 14061
  neuraminidase__InfluenzaA__AAY64215

SEQ ID NO: 14278 - protein, 469 aa, Artificial Sequence
  neuraminidase__InfluenzaA__AAY64225
MNPNQKIITIGSVSLTIATICFLMQITILVTTVTLHFKQYECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEENEVWWTSNSIVVFCGTSGTYGTGSWPDGADINLMPI

SEQ ID NO: 14279 - protein, 469 aa, Artificial Sequence
  neuraminidase__InfluenzaA__AAY64245
MNPNQKIITIGSVSLTIATICFLMQIAILVTTVTLHFKQYECNSLPNNQVMLCEPTILERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYGGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14280 - protein, 469 aa, Artificial Sequence; identical to SEQ ID NO: 14061
  neuraminidase__InfluenzaA__AAY64255

SEQ ID NO: 14281 - protein, 469 aa, Artificial Sequence; identical to SEQ ID NO: 14279
  neuraminidase__InfluenzaA__AAY64265

SEQ ID NO: 14282 - protein, 469 aa, Artificial Sequence; identical to SEQ ID NO: 14279
  neuraminidase__InfluenzaA__AAY64285

SEQ ID NO: 14283 - protein, 469 aa, Artificial Sequence
  neuraminidase__InfluenzaA__AAY64295
MNPNQKIITIGSVSLTIATICFLMQIAILVTTVTLHFKQYECNSPPNNQVMLCEPTIIERNITEIVYLTNTTIEKEICPKLSEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDHSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14284 - protein, 469 aa, Artificial Sequence
  neuraminidase__InfluenzaA__AAY64305
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHTSKLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVERGNMSGYSGIFSVEGKSCINRCFYVELIRGRKQETEVWWTSNSIVVFCGTSGTYGTGSWPDGADINLMPI

SEQ ID NO: 14285 - protein, 469 aa, Artificial Sequence; identical to SEQ ID NO: 14135
  neuraminidase__InfluenzaA__AAY64335

SEQ ID NO: 14286 - protein, 469 aa, Artificial Sequence; identical to SEQ ID NO: 14150
  neuraminidase__InfluenzaA__AAY64365

SEQ ID NO: 14287 - protein, 469 aa, Artificial Sequence
  neuraminidase__InfluenzaA__AAY64385
MNPNQKIITIGSVSLTIATICFLMQIAILVTTVTLHFKQYECNSLPNNQVMLCEPTILERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYGGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKSRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14288 - protein, 469 aa, Artificial Sequence
  neuraminidase__InfluenzaA__AAY64395
MNPNQKIITIGSVSLIISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIKEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNSNSKLQINRQVIVDRGNRSGYSGIFSVEGKSCINRCFYVELIRGRKEETEVLWTSNSIVVFCGTSGTYGTGSWPDGADINLMPI

SEQ ID NO: 14289 - protein, 469 aa, Artificial Sequence; identical to SEQ ID NO: 14284
  neuraminidase__InfluenzaA__AAY64405

SEQ ID NO: 14290 - protein, 469 aa, Artificial Sequence; identical to SEQ ID NO: 14279
  neuraminidase__InfluenzaA__AAY98040

SEQ ID NO: 14291 - protein, 469 aa, Artificial Sequence; identical to SEQ ID NO: 14279
  neuraminidase__InfluenzaA__AAY98050

SEQ ID NO: 14292 - protein, 469 aa, Artificial Sequence; identical to SEQ ID NO: 14171
  neuraminidase__InfluenzaA__AAY98060

SEQ ID NO: 14293 - protein, 469 aa, Artificial Sequence
  neuraminidase__InfluenzaA__AAY98070
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDHSIVSSYVCSGLVGDTPRKNDSFSSSHCLDPNNEEGGHGVKGWAFDDGNDVWMGRTISEKLRSGYEIFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14294 - protein, 469 aa, Artificial Sequence; identical to SEQ ID NO: 14179
  neuraminidase__InfluenzaA__AAY98080

SEQ ID NO: 14295 - protein, 469 aa, Artificial Sequence
  neuraminidase__InfluenzaA__AAY98090
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGKADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14296 - protein, 469 aa, Artificial Sequence; identical to SEQ ID NO: 14279
  neuraminidase__InfluenzaA__AAY98100

SEQ ID NO: 14297 - protein, 469 aa, Artificial Sequence; identical to SEQ ID NO: 14279
  neuraminidase__InfluenzaA__AAY98110

SEQ ID NO: 14298 - protein, 469 aa, Artificial Sequence; identical to SEQ ID NO: 14279
  neuraminidase__InfluenzaA__AAY98120

SEQ ID NO: 14299 - protein, 469 aa, Artificial Sequence; identical to SEQ ID NO: 14279
  neuraminidase__InfluenzaA__AAY98130

SEQ ID NO: 14300 - protein, 469 aa, Artificial Sequence; identical to SEQ ID NO: 14279
  neuraminidase__InfluenzaA__AAY98150

SEQ ID NO: 14301 - protein, 469 aa, Artificial Sequence
  neuraminidase__InfluenzaA__AAY98160
MNPNQKIITIGSVSLTIATICFLMQIAILVTTVTLHFKQYECNSLPNNQVMLCEPTILERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYGGRLVDSIGSWSKKILRTQESECVCINGTCTVVMTDGSASGRADTKILFIEEGKIIHISQLSGNAQHVEECSCYPRYPGVRCVCRDNWKGSNRPIVDINVKDYSIVSSYVCSGLVGDTPRKNDSSSSSNCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14302 - protein, 469 aa, Artificial Sequence; identical to SEQ ID NO: 14279
  neuraminidase__InfluenzaA__AAY98170

SEQ ID NO: 14303 - protein, 469 aa, Artificial Sequence; identical to SEQ ID NO: 14279
  neuraminidase__InfluenzaA__AAY98180

SEQ ID NO: 14304 - protein, 469 aa, Artificial Sequence; identical to SEQ ID NO: 14279
  neuraminidase__InfluenzaA__AAY98200

SEQ ID NO: 14305 - protein, 469 aa, Artificial Sequence; identical to SEQ ID NO: 14279
  neuraminidase__InfluenzaA__AAY98210

SEQ ID NO: 14306 - protein, 469 aa, Artificial Sequence; identical to SEQ ID NO: 14284
  neuraminidase__InfluenzaA__AAY98220

SEQ ID NO: 14307 - protein, 469 aa, Artificial Sequence; identical to SEQ ID NO: 14279
  neuraminidase__InfluenzaA__AAY98230

SEQ ID NO: 14308 - protein, 469 aa, Artificial Sequence
  neuraminidase__InfluenzaA__AAY98250
MNPNQKIITIGSVSLTIATICFLMQIAILVTTVTLHFKQYECNSLPNNQVMLCEPTILERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYGGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEDKSCINRCFYVELIRGRKQETEVWWTSNSIVVFCGTSGTYGTGSWPDGADINLMPI

SEQ ID NO: 14309 - protein, 469 aa, Artificial Sequence; identical to SEQ ID NO: 14279
  neuraminidase__InfluenzaA__AAY98322

SEQ ID NO: 14310 - protein, 469 aa, Artificial Sequence; identical to SEQ ID NO: 14284
  neuraminidase__InfluenzaA__AAY98332

SEQ ID NO: 14311 - protein, 469 aa, Artificial Sequence; identical to SEQ ID NO: 14279
  neuraminidase__InfluenzaA__AAY98342

SEQ ID NO: 14312 - protein, 469 aa, Artificial Sequence; identical to SEQ ID NO: 14279
  neuraminidase__InfluenzaA__AAY98359

SEQ ID NO: 14313 - protein, 469 aa, Artificial Sequence; identical to SEQ ID NO: 14284
  neuraminidase__InfluenzaA__AAY98369

SEQ ID NO: 14314 - protein, 469 aa, Artificial Sequence
  neuraminidase__InfluenzaA__AAY98379
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYGGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRNNRSGYSGIFSVEGKSCINRCFYVELIRGRKQETEVWWTSNSIVVFCGTSGTYGTGSWPDGADINLMPI

SEQ ID NO: 14315 - protein, 469 aa, Artificial Sequence
  neuraminidase__InfluenzaA__AAY98389
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYGGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14316 - protein, 469 aa, Artificial Sequence; identical to SEQ ID NO: 14279
  neuraminidase__InfluenzaA__AAY98399

SEQ ID NO: 14317 - protein, 469 aa, Artificial Sequence; identical to SEQ ID NO: 14279
  neuraminidase__InfluenzaA__AAY98409

SEQ ID NO: 14318 - protein, 469 aa, Artificial Sequence; identical to SEQ ID NO: 14279
  neuraminidase__InfluenzaA__AAY98773

SEQ ID NO: 14319 - protein, 469 aa, Artificial Sequence
  neuraminidase__InfluenzaA__AAZ32955
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDIVHERTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14320 - protein, 447 aa, Artificial Sequence
  neuraminidase__InfluenzaA__AAZ32957
MNPNQKIITIGSVSLTISTICFFMQIAILITTVTLIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGNASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14321 - protein, 447 aa, Artificial Sequence; identical to SEQ ID NO: 14320
  neuraminidase__InfluenzaA__AAZ32958

SEQ ID NO: 14322 - protein, 447 aa, Artificial Sequence; identical to SEQ ID NO: 14320
  neuraminidase__InfluenzaA__AAZ32959

SEQ ID NO: 14323 - protein, 469 aa, Artificial Sequence; identical to SEQ ID NO: 14284
  neuraminidase__InfluenzaA__AAZ38465

SEQ ID NO: 14324 - protein, 469 aa, Artificial Sequence; identical to SEQ ID NO: 14284
  neuraminidase__InfluenzaA__AAZ38476

SEQ ID NO: 14325 - protein, 469 aa, Artificial Sequence
  neuraminidase__InfluenzaA__AAZ38487
MNPNQKIITIGSVSLTIATICFLMQIAILVTTVTLHFKQYECNSLPNNQVMLCEPTILERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYGGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSNCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14326 - protein, 469 aa, Artificial Sequence
  neuraminidase__InfluenzaA__AAZ38509
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNSNSKLQINRQVIVDRGNRSGYSGIFSVEGKSCINRCFYVELIRGRKEETEVLWTSNSIVVFCGTSGTYGTGSWPDGADINLMPI

SEQ ID NO: 14327 - protein, 469 aa, Artificial Sequence
  neuraminidase__InfluenzaA__AAZ38586
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14328 - protein, 469 aa, Artificial Sequence; identical to SEQ ID NO: 14327
  neuraminidase__InfluenzaA__AAZ38597

SEQ ID NO: 14329 - protein, 469 aa, Artificial Sequence
  neuraminidase__InfluenzaA__AAZ38608
MNPNQKIITIGSVSLTISTICFFMQIAILITTVTLHFKQYEFNSPPNNQVMLCEPTIIERNITEIVYLTNTTIEKEMCPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIIHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKEETEVLWTSNSIVVFCGTSGTYGTGSWPDGADTNLMPI

SEQ ID NO: 14330 - protein, 469 aa, Artificial Sequence
  neuraminidase__InfluenzaA__AAZ38619
MNPNQKIITIGSVSLTISTICFFMQIAILITTVTLHFKQYEFNSPPNNQVMLCEPTIIERNITEIVYLTNTTIEKEMCPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIIHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14331 - protein, 469 aa, Artificial Sequence; identical to SEQ ID NO: 14327
  neuraminidase__InfluenzaA__AAZ38641

SEQ ID NO: 14332 - protein, 469 aa, Artificial Sequence; identical to SEQ ID NO: 14327
  neuraminidase__InfluenzaA__AAZ38653

SEQ ID NO: 14333 - protein, 469 aa, Artificial Sequence; identical to SEQ ID NO: 14118
  neuraminidase__InfluenzaA__AAZ43386

SEQ ID NO: 14334 - protein, 469 aa, Artificial Sequence
  neuraminidase__InfluenzaA__AAZ43397
MNPNQKIITIGSVSLTIATICFLMQIAILVTTVTLHFKQHECNSPPNNQVMLCEPTIIERNITEIVYLTNTTIEREICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14335 - protein, 469 aa, Artificial Sequence
  neuraminidase__InfluenzaA__AAZ43408
MNPNQKIITIGSVSLTIATICFLMQIAILVTTVTLHFKQYECNSPPNNQVMLCEPTMIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 14336 - protein, 469 aa, Artificial Sequence
  neuraminidase__InfluenzaA__AAZ74355
MNPNQKIITIGSVSLTIATICFLMQIAILVTTVTLHFKQHECNSPPNNQAMPCEPAIIERNTTETVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14337 - protein, 469 aa, Artificial Sequence
  neuraminidase__InfluenzaA__AAZ74366
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGKADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDKDNRSGYSGIFSVEGKSCINRCFYVELIRGRKQETEVWWTSNSIVVFCGTSGTYGTGSWPDGADINLMPI

SEQ ID NO: 14338 - protein, 469 aa, Artificial Sequence
  neuraminidase__InfluenzaA__AAZ74377
MNPNQKIITIGSVSLTIATICFLTQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTIREKLRSGYETFKVIEGWSKPNSKLQINRQVIVDRDNRSGYSGIFSVEGKSCINRCFYVELIRGRNQETEVLWTSNSIVVFCGTSGTYGTGSWPDGADINLMPI

SEQ ID NO: 14339 - protein, 469 aa, Artificial Sequence
  neuraminidase__InfluenzaA__AAZ74400
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASLIYDGRLVDSIGSWSKKILRTQESECVCINGTCTVVMTDGSASGRADTKILFIEEGKIVHTSKLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVERGNMSGYSGIFSVEGKSCINRCFYVELIRGRKQETEVWWTSNSIVVFCGTSGTYGTGSWPDGADINLMPI

SEQ ID NO: 14340 - protein, 469 aa, Artificial Sequence; identical to SEQ ID NO: 14279
  neuraminidase__InfluenzaA__AAZ74411

SEQ ID NO: 14341 - protein, 469 aa, Artificial Sequence
  neuraminidase__InfluenzaA__AAZ74422
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCAVVMTDGSASGKADTKILFIEEGKIVHTSKLSGSAQHVEECSCYPRYPGIRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14342 - protein, 469 aa, Artificial Sequence; identical to SEQ ID NO: 14327
  neuraminidase__InfluenzaA__AAZ74444

SEQ ID NO: 14343 - protein, 469 aa, Artificial Sequence
  neuraminidase__InfluenzaA__AAZ74455
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQINRQVIVERGNRSGYSGIFSVEGKSCINRCFYVELIRGRKEETEVLWTSNSIVVFCGTSGTYGTGSWPDGADINLMPI

SEQ ID NO: 14344 - protein, 469 aa, Artificial Sequence; identical to SEQ ID NO: 14327
  neuraminidase__InfluenzaA__AAZ74477

SEQ ID NO: 14345 - protein, 469 aa, Artificial Sequence; identical to SEQ ID NO: 14343
  neuraminidase__InfluenzaA__AAZ74488

SEQ ID NO: 14346 - protein, 469 aa, Artificial Sequence
  neuraminidase__InfluenzaA__AAZ74499
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCAVVMTDGSASGKADTKILFIEEGKIVHTSKLSGSAQHVEECSCYPRYPGIRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14347 - protein, 469 aa, Artificial Sequence; identical to SEQ ID NO: 14343
  neuraminidase__InfluenzaA__AAZ74510

SEQ ID NO: 14348 - protein, 469 aa, Artificial Sequence; identical to SEQ ID NO: 14346
  neuraminidase__InfluenzaA__AAZ74521

SEQ ID NO: 14349 - protein, 469 aa, Artificial Sequence
  neuraminidase__InfluenzaA__AAZ74532
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKDILRTQESECVCINGTCTVVMTDGSASGKADTKILFIEEGKIVHTSTLSGNAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQINRQVIVERGNRSGYSGIFSVEGKSCINRCFYVELIRGRKEETEVLWTSNSIVVFCGTSGTYGTGSWPDGANINLMPI

SEQ ID NO: 14350 - protein, 469 aa, Artificial Sequence; identical to SEQ ID NO: 14327
  neuraminidase__InfluenzaA__AAZ74543

SEQ ID NO: 14351 - protein, 469 aa, Artificial Sequence; identical to SEQ ID NO: 14279
  neuraminidase__InfluenzaA__AAZ74565

SEQ ID NO: 14352 - protein, 469 aa, Artificial Sequence; identical to SEQ ID NO: 14327
  neuraminidase__InfluenzaA__AAZ74598

SEQ ID NO: 14353 - protein, 469 aa, Artificial Sequence
  neuraminidase__InfluenzaA__AAZ74609
MNPNQKIITIGSVSLTIATICFLMQIAILVTTVTLHFKQYECNSPPNNQVMLCEPIIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSISSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 14354 - protein, 469 aa, Artificial Sequence; identical to SEQ ID NO: 14061
  neuraminidase__InfluenzaA__AAZ74620

SEQ ID NO: 14355 - protein, 469 aa, Artificial Sequence; identical to SEQ ID NO: 14173
  neuraminidase__InfluenzaA__AAZ79508

SEQ ID NO: 14356 - protein, 469 aa, Artificial Sequence
  neuraminidase__InfluenzaA__AAZ79519
MNPNQKIITIGSVSLTIATICFLMQIAILVTTVTLHFKQYECNSPPNNQVMLCEPTILERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDKNATASFIYGGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSRPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14357 - protein, 469 aa, Artificial Sequence; identical to SEQ ID NO: 14137
  neuraminidase__InfluenzaA__AAZ79530

SEQ ID NO: 14358 - protein, 469 aa, Artificial Sequence
  neuraminidase__InfluenzaA__AAZ79552
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPHRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRDNRSGYSGIFSVEGKSCINRCFYVELIRGRNQETEVLWTSNSIVVFCGTSGTYGTGSWPDGADINLMPI

SEQ ID NO: 14359 - protein, 469 aa, Artificial Sequence; identical to SEQ ID NO: 14279
  neuraminidase__InfluenzaA__AAZ79563

SEQ ID NO: 14360 - protein, 469 aa, Artificial Sequence; identical to SEQ ID NO: 14279
  neuraminidase__InfluenzaA__AAZ79574

SEQ ID NO: 14361 - protein, 469 aa, Artificial Sequence; identical to SEQ ID NO: 14279
  neuraminidase__InfluenzaA__AAZ79585

SEQ ID NO: 14362 - protein, 469 aa, Artificial Sequence; identical to SEQ ID NO: 14346
  neuraminidase__InfluenzaA__AAZ79618

SEQ ID NO: 14363 - protein, 469 aa, Artificial Sequence; identical to SEQ ID NO: 14327
  neuraminidase__InfluenzaA__AAZ79633

SEQ ID NO: 14364 - protein, 469 aa, Artificial Sequence; identical to SEQ ID NO: 14346
  neuraminidase__InfluenzaA__AAZ79945

SEQ ID NO: 14365 - protein, 469 aa, Artificial Sequence; identical to SEQ ID NO: 14343
  neuraminidase__InfluenzaA__AAZ79966

SEQ ID NO: 14366 - protein, 469 aa, Artificial Sequence; identical to SEQ ID NO: 14327
  neuraminidase__InfluenzaA__AAZ79977

SEQ ID NO: 14367 - protein, 469 aa, Artificial Sequence; identical to SEQ ID NO: 14327
  neuraminidase__InfluenzaA__AAZ79988

SEQ ID NO: 14368 - protein, 469 aa, Artificial Sequence
  neuraminidase__InfluenzaA__AAZ79999
MNPNQKIITIGSVSLTISTICFFMQIAILITTVTLHFKQYEFNSPPNNQMMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQINRQVIVERGNRSGYSGIFSVEGKSCINRCFYVELIRGRKEETEVLWTSNSIVVFCGTSGTYGTGSWPDGADINLMPI

SEQ ID NO: 14369 - protein, 469 aa, Artificial Sequence; identical to SEQ ID NO: 14115
  neuraminidase__InfluenzaA__AAZ80010

SEQ ID NO: 14370 - protein, 469 aa, Artificial Sequence
  neuraminidase__InfluenzaA__AAZ80021
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCAVVMTDGSASGKADTKILFIEEGKIVHTSKLSGSAQHVEECSCYPRYPGIRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14371 - protein, 469 aa, Artificial Sequence
  neuraminidase__InfluenzaA__AAZ83245
MNPNQKIITIGSVSLTISTICFFMQIAILITTVTLHFKQYEFNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRDNRSGYSGIFSVEGKSCINRCFYVELIRGRNQETEVLWTSNSIVVFCGTSGTYGTGSWPDGADINLMPI

SEQ ID NO: 14372 - protein, 470 aa, Artificial Sequence
  neuraminidase__InfluenzaA__AAZ83256
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGIDSDTANWSWPDGAELPFTIDK

SEQ ID NO: 14373 - protein, 469 aa, Artificial Sequence; identical to SEQ ID NO: 14279
  neuraminidase__InfluenzaA__AAZ83269

SEQ ID NO: 14374 - protein, 469 aa, Artificial Sequence; identical to SEQ ID NO: 14279
  neuraminidase__InfluenzaA__AAZ83280

SEQ ID NO: 14375 - protein, 469 aa, Artificial Sequence; identical to SEQ ID NO: 14253
  neuraminidase__InfluenzaA__AAZ83291

SEQ ID NO: 14376 - protein, 470 aa, Artificial Sequence
  neuraminidase__InfluenzaA__AAZ83302
MNPNQKIITIGSISIAIGIISLMLQIGNIISIWASHSIQTGSQNHTGVCNQRIITYENSTWVNHTYVNINNTNVIAGKDKASVTLAGNSSLCSISGWAIYTKDNSIRIGSKGDVFVIREPFISCSHSECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14377 - protein, 469 aa, Artificial Sequence
  neuraminidase__InfluenzaA__AAZ83315
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRANTKILFIEEGKIIHISQLSGSAQHVEECSCYPRYPGVRCVCRDNWKGSNRPIVDINVKDYSIASSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14378 - protein, 469 aa, Artificial Sequence
  neuraminidase__InfluenzaA__AAZ83326
MNPNQKIITIGSVSLTIATICFLMQIAILVTTVTLHFKQYECDSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14379 - protein, 469 aa, Artificial Sequence
  neuraminidase__InfluenzaA__AAZ83374
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRTGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14380 - protein, 469 aa, Artificial Sequence; identical to SEQ ID NO: 14346
  neuraminidase__InfluenzaA__AAZ83385

SEQ ID NO: 14381 - protein, 470 aa, Artificial Sequence
  neuraminidase__InfluenzaA__AAZ85129
MNTNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14382 - protein, 469 aa, Artificial Sequence
  neuraminidase__InfluenzaA__ABA06513
MNPNQKIITIGSVSLTIATICFLTQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRDNRSGYSGIFSVEGKSCINRCFYVELIRGRNQETEVLWTSNSIVVFCGTSGTYGTGSWPDGADINLMPI

SEQ ID NO: 14383 - protein, 469 aa, Artificial Sequence; identical to SEQ ID NO: 14382
  neuraminidase__InfluenzaA__ABA06545

SEQ ID NO: 14384 - protein, 470 aa, Artificial Sequence
  neuraminidase__InfluenzaA__ABA08478
MNTNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 14385 - protein, 469 aa, Artificial Sequence; identical to SEQ ID NO: 14382
  neuraminidase__InfluenzaA__ABA08511

SEQ ID NO: 14386 - protein, 470 aa, Artificial Sequence
  neuraminidase__InfluenzaA__ABA12699
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 14387 - protein, 470 aa, Artificial Sequence; identical to SEQ ID NO: 14386
  neuraminidase__InfluenzaA__ABA12710

SEQ ID NO: 14388 - protein, 470 aa, Artificial Sequence
  neuraminidase__InfluenzaA__ABA12721
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIGKGKVTKSIELNAPNFHYEECSCYPDTGTVMCVCRDNWHGSNRPWVSFNQNLDYQIGYICSGVFGDNPRPRDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 14389 - protein, 470 aa, Artificial Sequence; identical to SEQ ID NO: 14386
  neuraminidase__InfluenzaA__ABA12732

SEQ ID NO: 14390 - protein, 469 aa, Artificial Sequence; identical to SEQ ID NO: 14327
  neuraminidase__InfluenzaA__ABA12743

SEQ ID NO: 14391 - protein, 469 aa, Artificial Sequence; identical to SEQ ID NO: 14343
  neuraminidase__InfluenzaA__ABA12754

SEQ ID NO: 14392 - protein, 469 aa, Artificial Sequence; identical to SEQ ID NO: 14346
  neuraminidase__InfluenzaA__ABA12765

SEQ ID NO: 14393 - protein, 469 aa, Artificial Sequence; identical to SEQ ID NO: 14118
  neuraminidase__InfluenzaA__ABA12776

SEQ ID NO: 14394 - protein, 469 aa, Artificial Sequence; identical to SEQ ID NO: 14327
  neuraminidase__InfluenzaA__ABA12786

SEQ ID NO: 14395 - protein, 469 aa, Artificial Sequence; identical to SEQ ID NO: 14346
  neuraminidase__InfluenzaA__ABA18029

SEQ ID NO: 14396 - protein, 470 aa, Artificial Sequence
  neuraminidase__InfluenzaA__ABA18040
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14397 - protein, 469 aa, Artificial Sequence
  neuraminidase__InfluenzaA__ABA18126
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDMWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14398 - protein, 470 aa, Artificial Sequence; identical to SEQ ID NO: 14386
  neuraminidase__InfluenzaA__ABA18148

SEQ ID NO: 14399 - protein, 469 aa, Artificial Sequence
  neuraminidase__InfluenzaA__ABA18159
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCAVVMTDGSASGKADTKILFIEEGKIVHTSKLSGSAQHVEECSCYPRYPGIRCVCRDNWKGSNRPIVDVNIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14400 - protein, 469 aa, Artificial Sequence; identical to SEQ ID NO: 14327
  neuraminidase__InfluenzaA__ABA26703

SEQ ID NO: 14401 - protein, 469 aa, Artificial Sequence; identical to SEQ ID NO: 14327
  neuraminidase__InfluenzaA__ABA26714

SEQ ID NO: 14402 - protein, 469 aa, Artificial Sequence; identical to SEQ ID NO: 14327
  neuraminidase__InfluenzaA__ABA26736

SEQ ID NO: 14403 - protein, 469 aa, Artificial Sequence; identical to SEQ ID NO: 14327
  neuraminidase__InfluenzaA__ABA26747

SEQ ID NO: 14404 - protein, 469 aa, Artificial Sequence; identical to SEQ ID NO: 14327
  neuraminidase__InfluenzaA__ABA26758

SEQ ID NO: 14405 - protein, 469 aa, Artificial Sequence; identical to SEQ ID NO: 14327
  neuraminidase__InfluenzaA__ABA26769

SEQ ID NO: 14406 - protein, 469 aa, Artificial Sequence; identical to SEQ ID NO: 14327
  neuraminidase__InfluenzaA__ABA26780

SEQ ID NO: 14407 - protein, 469 aa, Artificial Sequence; identical to SEQ ID NO: 14327
  neuraminidase__InfluenzaA__ABA26791

SEQ ID NO: 14408 - protein, 469 aa, Artificial Sequence; identical to SEQ ID NO: 14327
  neuraminidase__InfluenzaA__ABA26802

SEQ ID NO: 14409 - protein, 470 aa, Artificial Sequence
  neuraminidase__InfluenzaA__ABA42250
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGDGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 14410 - protein, 470 aa, Artificial Sequence; identical to SEQ ID NO: 14396
  neuraminidase__InfluenzaA__ABA42261

SEQ ID NO: 14411 - protein, 469 aa, Artificial Sequence
  neuraminidase__InfluenzaA__ABA42272
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTINEKLRLGYETFKVIEGWSNPNSKLQINRQVIVERGNRSGYSGIFSVEGKSCINRCFYVELIRGRKEETEVLWTSNSIVVFCGTSGTYGTGSWPDGADINLMPI

SEQ ID NO: 14412 - protein, 469 aa, Artificial Sequence; identical to SEQ ID NO: 14327
  neuraminidase__InfluenzaA__ABA42294

SEQ ID NO: 14413 - protein, 469 aa, Artificial Sequence; identical to SEQ ID NO: 14154
  neuraminidase__InfluenzaA__ABA42305

SEQ ID NO: 14414 - protein, 469 aa, Artificial Sequence; identical to SEQ ID NO: 14164
  neuraminidase__InfluenzaA__ABA42316

SEQ ID NO: 14415 - protein, 470 aa, Artificial Sequence
  neuraminidase__InfluenzaA__ABA42327
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 14416 - protein, 469 aa, Artificial Sequence; identical to SEQ ID NO: 14149
  neuraminidase__InfluenzaA__ABA42338

SEQ ID NO: 14417 - protein, 469 aa, Artificial Sequence
  neuraminidase__InfluenzaA__ABA42349
MNPNQKIITIGSVSLTIATICFLMQIAILVTTVTLHFKQYECDSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGKLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14418 - protein, 469 aa, Artificial Sequence; identical to SEQ ID NO: 14154
  neuraminidase__InfluenzaA__ABA42360

SEQ ID NO: 14419 - protein, 469 aa, Artificial Sequence; identical to SEQ ID NO: 14149
  neuraminidase__InfluenzaA__ABA42371

SEQ ID NO: 14420 - protein, 469 aa, Artificial Sequence; identical to SEQ ID NO: 14164
  neuraminidase__InfluenzaA__ABA42382

SEQ ID NO: 14421 - protein, 469 aa, Artificial Sequence; identical to SEQ ID NO: 14149
  neuraminidase__InfluenzaA__ABA42393

SEQ ID NO: 14422 - protein, 469 aa, Artificial Sequence
  neuraminidase__InfluenzaA__ABA42404
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVNISTLPGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14423 - protein, 469 aa, Artificial Sequence; identical to SEQ ID NO: 14164
  neuraminidase__InfluenzaA__ABA42415

SEQ ID NO: 14424 - protein, 469 aa, Artificial Sequence; identical to SEQ ID NO: 14171
  neuraminidase__InfluenzaA__ABA42446

SEQ ID NO: 14425 - protein, 469 aa, Artificial Sequence
  neuraminidase__InfluenzaA__ABA42457
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVESKSCINRCFYVELIRGRKEETEVWWTSNSIVVFCGTSGTYGTGSWPDGADINLMPI

SEQ ID NO: 14426 - protein, 469 aa, Artificial Sequence; identical to SEQ ID NO: 14171
  neuraminidase__InfluenzaA__ABA42468

SEQ ID NO: 14427 - protein, 469 aa, Artificial Sequence
  neuraminidase__InfluenzaA__ABA42479
MNPNQKIITIGSVSLTIATICFLMQIAILVTTVTLHFKQYECDSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEDGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14428 - protein, 469 aa, Artificial Sequence
  neuraminidase__InfluenzaA__ABA42490
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISKLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIKGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14429 - protein, 469 aa, Artificial Sequence; identical to SEQ ID NO: 14171
  neuraminidase__InfluenzaA__ABA42501

SEQ ID NO: 14430 - protein, 469 aa, Artificial Sequence
  neuraminidase__InfluenzaA__ABA42512
MNPNQKIITIGSVSLTIATICFLMQIAILVTTVTLHFKQYECNSPPNNQVMLCEPTIIERNITEIVYPTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14431 - protein, 469 aa, Artificial Sequence; identical to SEQ ID NO: 14061
  neuraminidase__InfluenzaA__ABA42523

SEQ ID NO: 14432 - protein, 469 aa, Artificial Sequence; identical to SEQ ID NO: 14061
  neuraminidase__InfluenzaA__ABA42534

SEQ ID NO: 14433 - protein, 469 aa, Artificial Sequence; identical to SEQ ID NO: 14253
  neuraminidase__InfluenzaA__ABA42545

SEQ ID NO: 14434 - protein, 469 aa, Artificial Sequence
  neuraminidase__InfluenzaA__ABA42556
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQEAEVLWTSNSIVVFCGTSGTYGTGSWPDGADINLMPI

SEQ ID NO: 14435 - protein, 469 aa, Artificial Sequence; identical to SEQ ID NO: 14061
  neuraminidase__InfluenzaA__ABA42567

SEQ ID NO: 14436 - protein, 469 aa, Artificial Sequence
  neuraminidase__InfluenzaA__ABA42931
MNPNQKIITIGSVSLTIATICSLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14437 - protein, 469 aa, Artificial Sequence; identical to SEQ ID NO: 14061
  neuraminidase__InfluenzaA__ABA42942

SEQ ID NO: 14438 - protein, 469 aa, Artificial Sequence; identical to SEQ ID NO: 14061
  neuraminidase__InfluenzaA__ABA42981

SEQ ID NO: 14439 - protein, 469 aa, Artificial Sequence; identical to SEQ ID NO: 14149
  neuraminidase__InfluenzaA__ABA42992

SEQ ID NO: 14440 - protein, 470 aa, Artificial Sequence
  neuraminidase__InfluenzaA__ABA43192
MNPNQKIITIGSISIAIGIISLMLQIGNIISIWASHSIQTGSQNHTGVCNQRIITYENSTWVNHTYVNINNTNVIAGKDKTSVILAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVSITDWSGYSGSFVQHPELTGLDCIRPCFWVELVRGLPKENTTIWTSGSSISFCGVNSDTANWSWPDGAELPFTIDK

SEQ ID NO: 14441 - protein, 469 aa, Artificial Sequence; identical to SEQ ID NO: 14346
  neuraminidase__InfluenzaA__ABA43203

SEQ ID NO: 14442 - protein, 469 aa, Artificial Sequence
  neuraminidase__InfluenzaA__ABA43339
MNPNQKIITIGSVSLSIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCMAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 14443 - protein, 469 aa, Artificial Sequence
  neuraminidase__InfluenzaA__ABA54916
MNPNQKIITTGSICMVIGMVSLMLQIGNIISIWVSHSIQTGTQHRAEPCNRSIINYENNTWVNQTYVKISNTNFLTEKAVASVRLVGNSSLCPISGWAVYSKDNSIRIGSKGDVFVIREPFISCSHLECRTFFLTQGALLNDKHSNGTVKDRSPYRTLMSCPVGEAPSPYNSRFESVAWSASACHDGTSWLTIGISGPDNGAVAVLKYNGIITDTIKSWRNNILRAQESECACVNGSCFTVMTDGPSNGQASYKIFKIEKGKVVKSVELNAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSISFCGVNSDTVGWSWPDGAELPFTIDK

SEQ ID NO: 14444 - protein, 470 aa, Artificial Sequence
  neuraminidase__InfluenzaA__ABA87048
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNRAASYKIFKIEKGKVTKSVELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14445 - protein, 470 aa, Artificial Sequence
  neuraminidase__InfluenzaA__ABA87060
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGTASYKIFKIEKGKVTKSIELNAPNFHYEECSCYPDTGTVMCVCRDNWHGSNRPWVSFNQNLDYQIGYICSGVFGDNPRPKDGKGSCSPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 14446 - protein, 470 aa, Artificial Sequence
  neuraminidase__InfluenzaA__ABA87083
MNPNQKIITIGSISIAIGIISLMLQIGNIISIWASHSIQTGSQNHTGICNQKIITYKNSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSVFSVKQDVVAITDWSGYSGSFVQHPELTGLDCIRPCFWVELVRGLPRENTTIWTSGSSISFCGVNSDTANWSWPDGAELPFTIDK

SEQ ID NO: 14447 - protein, 470 aa, Artificial Sequence
  neuraminidase__InfluenzaA__ABA87234
MNSNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVIKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14448 - protein, 469 aa, Artificial Sequence; identical to SEQ ID NO: 14382
  neuraminidase__InfluenzaA__ABB02784

SEQ ID NO: 14449 - protein, 470 aa, Artificial Sequence; identical to SEQ ID NO: 14386
  neuraminidase__InfluenzaA__ABB02795

SEQ ID NO: 14450 - protein, 470 aa, Artificial Sequence; identical to SEQ ID NO: 14386
  neuraminidase__InfluenzaA__ABB02806

SEQ ID NO: 14451 - protein, 470 aa, Artificial Sequence
  neuraminidase__InfluenzaA__ABB02817
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSVELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14452 - protein, 470 aa, Artificial Sequence; identical to SEQ ID NO: 14451
  neuraminidase__InfluenzaA__ABB02828

SEQ ID NO: 14453 - protein, 469 aa, Artificial Sequence
  neuraminidase__InfluenzaA__ABB02839
MNPNQKIITIGSVSLTISTICFFMQIAILITTVTLHFKQYEFNSPPNNQVVLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14454 - protein, 469 aa, Artificial Sequence
  neuraminidase__InfluenzaA__ABB02850
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCAVVITDGSASGKADTKILFIEEGKIVHTSKLSGSAQHVEECSCYPRYPGIRCVCRDNWKGSNRPIVDINIKDYSIVSSYVCSGLVGDTPRKNDSSSSSLCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14455 - protein, 469 aa, Artificial Sequence
  neuraminidase__InfluenzaA__ABB02861
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYDGRLVDSIGSWSKKILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADIDLMPI

SEQ ID NO: 14456 - protein, 469 aa, Artificial Sequence; identical to SEQ ID NO: 14253
  neuraminidase__InfluenzaA__ABB02872

SEQ ID NO: 14457 - protein, 469 aa, Artificial Sequence; identical to SEQ ID NO: 14253
  neuraminidase__InfluenzaA__ABB02883

SEQ ID NO: 14458 - protein, 469 aa, Artificial Sequence
  neuraminidase__InfluenzaA__ABB02894
MNPNQKIITIGSVSLTIATICFLMQIAILVTTVTLHFKQYECNSPPNNQVMLCEPTIIERNITEMVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14459 - protein, 469 aa, Artificial Sequence; identical to SEQ ID NO: 14061
  neuraminidase__InfluenzaA__ABB02905

SEQ ID NO: 14460 - protein, 470 aa, Artificial Sequence
  neuraminidase__InfluenzaA__ABB02916
MNPNQKIITIGSISIAIGIISLMLQIGNIISIWASHSIQTGSQNHTGVCNQRIITYENSTWVNHTYVNINNTNVIAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPRDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 14461 - protein, 470 aa, Artificial Sequence
  neuraminidase__InfluenzaA__ABB02927
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 14462 - protein, 470 aa, Artificial Sequence
  neuraminidase__InfluenzaA__ABB02939
MNPNQKIITIGSISIAIGIISLMLQIGNIISIWASHSIQTGSQNHTGVCNQRIITYENSTWMNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14463 - protein, 469 aa, Artificial Sequence; identical to SEQ ID NO: 14378
  neuraminidase__InfluenzaA__ABB02950

SEQ ID NO: 14464 - protein, 469 aa, Artificial Sequence; identical to SEQ ID NO: 14279
  neuraminidase__InfluenzaA__ABB02961

SEQ ID NO: 14465 - protein, 469 aa, Artificial Sequence; identical to SEQ ID NO: 14279
  neuraminidase__InfluenzaA__ABB02972

SEQ ID NO: 14466 - protein, 469 aa, Artificial Sequence; identical to SEQ ID NO: 14279
  neuraminidase__InfluenzaA__ABB02983

SEQ ID NO: 14467 - protein, 469 aa, Artificial Sequence; identical to SEQ ID NO: 14279
  neuraminidase__InfluenzaA__ABB02994

SEQ ID NO: 14468 - protein, 469 aa, Artificial Sequence; identical to SEQ ID NO: 14279
  neuraminidase__InfluenzaA__ABB03005

SEQ ID NO: 14469 - protein, 469 aa, Artificial Sequence; identical to SEQ ID NO: 14284
  neuraminidase__InfluenzaA__ABB03016

SEQ ID NO: 14470 - protein, 469 aa, Artificial Sequence; identical to SEQ ID NO: 14279
  neuraminidase__InfluenzaA__ABB03027

SEQ ID NO: 14471 - protein, 469 aa, Artificial Sequence; identical to SEQ ID NO: 14284
  neuraminidase__InfluenzaA__ABB03038

SEQ ID NO: 14472 - protein, 469 aa, Artificial Sequence; identical to SEQ ID NO: 14279
  neuraminidase__InfluenzaA__ABB03049

SEQ ID NO: 14473 - protein, 469 aa, Artificial Sequence
  neuraminidase__InfluenzaA__ABB03060
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGIRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14474 - protein, 469 aa, Artificial Sequence
  neuraminidase__InfluenzaA__ABB03071
MNPNQKIITIGSVSLTISTICFFMQIAILITTVTLHFKQYEFNSPPNNQVMLCEPTIIERNITEIVYLTNTTIEKEICPKLAEYRNWSKPQCGITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDKGNRSGYSGIFSVEGKSCINRCFYVELIRGRKEETEVLWTSNSIVVFCGTSGTYGTGSWPDGADINLMPI

SEQ ID NO: 14475 - protein, 469 aa, Artificial Sequence
  neuraminidase__InfluenzaA__ABB03093
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHIEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14476 - protein, 469 aa, Artificial Sequence; identical to SEQ ID NO: 14382
  neuraminidase__InfluenzaA__ABB03104

SEQ ID NO: 14477 - protein, 469 aa, Artificial Sequence
  neuraminidase__InfluenzaA__ABB03115
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQENEVLWTSNSIVVFCGTSGTYGTGSWPDGADINLMPI

SEQ ID NO: 14478 - protein, 470 aa, Artificial Sequence; identical to SEQ ID NO: 14386
  neuraminidase__InfluenzaA__ABB03126

SEQ ID NO: 14479 - protein, 470 aa, Artificial Sequence
  neuraminidase__InfluenzaA__ABB03148
MNPNQKIITIGSISIAIGTISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 14480 - protein, 469 aa, Artificial Sequence
  neuraminidase__InfluenzaA__ABB04286
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKSQINRQVIVDSGNRSGYSGIFSVEGKSCINRCFYVELIRGREQETRVWWTSNSIVVFCGTSGTYGTGSWPDGADINLMPI

SEQ ID NO: 14481 - protein, 469 aa, Artificial Sequence
  neuraminidase__InfluenzaA__ABB04297
MNPNQKIITIGSVSLTIATICFLMQIAILVTTVTLHFKQYECDSPANNQVIPCEPITIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14482 - protein, 469 aa, Artificial Sequence
  neuraminidase__InfluenzaA__ABB04319
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYNGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCQNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 14483 - protein, 469 aa, Artificial Sequence
  neuraminidase__InfluenzaA__ABB04341
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSVRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRKNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14484 - protein, 469 aa, Artificial Sequence
  neuraminidase__InfluenzaA__ABB04352
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 14485 - protein, 469 aa, Artificial Sequence
  neuraminidase__InfluenzaA__ABB04374
MNPNQKIITIGSVSLTIATVCFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDENATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVKDYSIDSRYVCSGLVGDTPRNNDKSSNSNCRNPNNDKGNHGVKGWAFDDGNDVWMGRTISKDSRSGYETFKVIGGWSTPNSKSQINRQVIVDSDNRSGYSGIFSVEGKSCINRCFYVELIRGREQETKVWWTSNSIVVFCGTSGTYGTGSWPDGADINLMPI

SEQ ID NO: 14486 - protein, 469 aa, Artificial Sequence
  neuraminidase__InfluenzaA__ABB04931
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSSSYCRNPNNEKGKHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14487 - protein, 469 aa, Artificial Sequence
  neuraminidase__InfluenzaA__ABB04942
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14488 - protein, 469 aa, Artificial Sequence; identical to SEQ ID NO: 14484
  neuraminidase__InfluenzaA__ABB04953

SEQ ID NO: 14489 - protein, 469 aa, Artificial Sequence; identical to SEQ ID NO: 14382
  neuraminidase__InfluenzaA__ABB04975

SEQ ID NO: 14490 - protein, 469 aa, Artificial Sequence; identical to SEQ ID NO: 14180
  neuraminidase__InfluenzaA__ABB04986

SEQ ID NO: 14491 - protein, 469 aa, Artificial Sequence
  neuraminidase__InfluenzaA__ABB04997
MNPNQKIITIGSVSLTIATICFLMQIAILVTTVTLHFKQYECNSPPNNQVMLCEPTIIERNITEIVHLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLKPI

SEQ ID NO: 14492 - protein, 469 aa, Artificial Sequence; identical to SEQ ID NO: 14253
  neuraminidase__InfluenzaA__ABB05008

SEQ ID NO: 14493 - protein, 469 aa, Artificial Sequence; identical to SEQ ID NO: 14061
  neuraminidase__InfluenzaA__ABB05186

SEQ ID NO: 14494 - protein, 469 aa, Artificial Sequence; identical to SEQ ID NO: 14253
  neuraminidase__InfluenzaA__ABB05219

SEQ ID NO: 14495 - protein, 469 aa, Artificial Sequence
  neuraminidase__InfluenzaA__ABB46395
MNPNQKIITIGSVSLTIATICFLMQIAILVTTVTLHFKQYECDSPANKQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSSSYCRNPNNEKGTHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14496 - protein, 469 aa, Artificial Sequence; identical to SEQ ID NO: 14040
  neuraminidase__InfluenzaA__ABB46417

SEQ ID NO: 14497 - protein, 469 aa, Artificial Sequence
  neuraminidase__InfluenzaA__ABB46428
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHISPLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKEETEVWWTSNSIVVFCGTSGTYGTGSWPDGADINLMPI

SEQ ID NO: 14498 - protein, 469 aa, Artificial Sequence
  neuraminidase__InfluenzaA__ABB46439
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGACTVVMTDGSASGKADTKILFIEERRIVHTSTLSGSAQHVEECSCYPRYPGVRCVCRDNWKGSNRPIVDINIKDYSIVSSYVCSGLVGDTPRKNDSSSSSNCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGAYGTGSWPDGADINLMPI

SEQ ID NO: 14499 - protein, 469 aa, Artificial Sequence; identical to SEQ ID NO: 14346
  neuraminidase__InfluenzaA__ABB46450

SEQ ID NO: 14500 - protein, 469 aa, Artificial Sequence; identical to SEQ ID NO: 14327
  neuraminidase__InfluenzaA__ABB46461

SEQ ID NO: 14501 - protein, 469 aa, Artificial Sequence
  neuraminidase__InfluenzaA__ABB46550
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCVNGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKSQINRQVIVDSGNRSGYSGIFSVEGKSCINRCFYVELIRGREQETRVWWTSNSIVVFCGTSGTYGTGSWPDGADINLMPI

SEQ ID NO: 14502 - protein, 469 aa, Artificial Sequence
  neuraminidase__InfluenzaA__ABB51955
MNPNQKIITIGSVSLTISTICFFMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDIVHDRTPYRTLLMNELGVPFHLGTKQVCIAWSSSSCHDGKAWLHVCVTGDDENATASFIYNGRLVDSIGSWSKKFFRTQESECVCIHGTCTVVMTDGSASRKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14503 - protein, 470 aa, Artificial Sequence
  neuraminidase__InfluenzaA__ABB51956
MNPNQKIITIGSISIAIGIISLMLQIGNIISIWASHSIQTGSQNHTGVCNQRIITYENSTWVNHTYVNINNTNVIAGKDKTSVTVAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKPILGTQESEWVCVNGSCFTIMTDDPSYEAASYKIFKIERERVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14504 - protein, 469 aa, Artificial Sequence
  neuraminidase__InfluenzaA__ABB51957
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVRDRTPYRTLLMNELGVPFHLGTRQVCIAWSSSSCHDGKAWLHVCVTGDDKNATASFIYNGRLVDSIGSWSKKIFRTQKFECVCIHWTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14505 - protein, 470 aa, Artificial Sequence
  neuraminidase__InfluenzaA__ABB51958
MNPNQKIITIGSISIAIGIISLMLQIGNIISIWASHSIQTGSQNHTGVCNQRIITYENSTWVNHTYVSINNTNVIAGKDKTSVTLAGNSSLCPIRGWAIYTKGNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSRYPDTGTVMCVCRDNWHGSNRPWVSFNQNLDYQIGYICSGVFGDNPRPKDGEGSCNPVTVDGANGVKGFSYKYGNGVGIGRTISNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14506 - protein, 469 aa, Artificial Sequence
  neuraminidase__InfluenzaA__ABB51959
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFNEEGKIVHTSTCSGSAQHVEECSCYSRYPGVRCVCRDNWKGSNRPIVDINIKDYSIVSSYVCSGLVGDTPRKNDSSSSSHCLDPNNEEGGHGVKGRAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14507 - protein, 470 aa, Artificial Sequence
  neuraminidase__InfluenzaA__ABB51960
MNPNQKIITIGSISIAIGIISLMLQIGNIIPIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSEFESVAWSASACHDGMGWLTIGISGPDNGAVAVLKYNGIITETIKSWKKQILRTQESECVCVNGSCFTIMTDGPSNGAASYKIFKIEKGKITKSIELNAPNSHYEECSCYPDTGTVMCVCRDSWHGSNRPWVSFNQNLDYQIGYICSGVFGDNPRPKDGEGSCNPVTVDGANGVKGFSYEYGNGDWIGRTKSNRLRKGFEMIWDPDGWTDTNSDFSVKQDVVAITDWSGYSGSFVQHPELTGLVCIRPCFWVELVRGLPKENTTIWTSGSSISFCGVNSDTANWSWPDGAELPFTIDK

SEQ ID NO: 14508 - protein, 469 aa, Artificial Sequence; identical to SEQ ID NO: 14343
  neuraminidase__InfluenzaA__ABB53617

SEQ ID NO: 14509 - protein, 469 aa, Artificial Sequence
  neuraminidase__InfluenzaA__ABB53721
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSSGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14510 - protein, 469 aa, Artificial Sequence
  neuraminidase__InfluenzaA__ABB53754
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14511 - protein, 469 aa, Artificial Sequence; identical to SEQ ID NO: 14103
  neuraminidase__InfluenzaA__ABB54517

SEQ ID NO: 14512 - protein, 469 aa, Artificial Sequence
  neuraminidase__InfluenzaA__ABB59999
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINIKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVTFCGTSGTYGTGSWPDGADINLMPI

SEQ ID NO: 14513 - protein, 469 aa, Artificial Sequence
  neuraminidase__InfluenzaA__ABB60010
MNPNQKIITIGSVSLTIATICFLMQIAILVTTVTLHFKQYEYSSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSRYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14514 - protein, 469 aa, Artificial Sequence
  neuraminidase__InfluenzaA__ABB77867
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDHSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14515 - protein, 469 aa, Artificial Sequence; identical to SEQ ID NO: 14514
  neuraminidase__InfluenzaA__ABB79719

SEQ ID NO: 14516 - protein, 469 aa, Artificial Sequence
  neuraminidase__InfluenzaA__ABB79734
MNPNQKIITIGSVSLTLSTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14517 - protein, 469 aa, Artificial Sequence; identical to SEQ ID NO: 14487
  neuraminidase__InfluenzaA__ABB79791

SEQ ID NO: 14518 - protein, 469 aa, Artificial Sequence
  neuraminidase__InfluenzaA__ABB79802
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 14519 - protein, 469 aa, Artificial Sequence
  neuraminidase__InfluenzaA__ABB79813
MNPNQKIITIGSVSLTIATICFLMQIAILVTTVTLHFKQYECNSPPNNQVMLCEPTIIERNITEIVYLTNTTIEKEVCPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14520 - protein, 469 aa, Artificial Sequence; identical to SEQ ID NO: 14519
  neuraminidase__InfluenzaA__ABB79960

SEQ ID NO: 14521 - protein, 469 aa, Artificial Sequence; identical to SEQ ID NO: 14519
  neuraminidase__InfluenzaA__ABB79971

SEQ ID NO: 14522 - protein, 470 aa, Artificial Sequence
  neuraminidase__InfluenzaA__ABB79982
MNANQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14523 - protein, 470 aa, Artificial Sequence; identical to SEQ ID NO: 14451
  neuraminidase__InfluenzaA__ABB79993

SEQ ID NO: 14524 - protein, 469 aa, Artificial Sequence
  neuraminidase__InfluenzaA__ABB80004
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSTVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14525 - protein, 469 aa, Artificial Sequence; identical to SEQ ID NO: 14509
  neuraminidase__InfluenzaA__ABB80015

SEQ ID NO: 14526 - protein, 469 aa, Artificial Sequence
  neuraminidase__InfluenzaA__ABB80037
MNPNQKIITIGSVSLTIATVCFLMQIAILVTTVTLHFKQYECDSPANNQVMPCEPIIIERNITEIVYLNNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVEDYSIDSSYVCSGLVGDTPRNNDRSSNSNCRNPNNERGNHGVKGWAFDDGNDVWMGRTISKDLRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI
